United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 33

SEQ ID NO: 41951 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 41952 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 41953 - protein, 2039 aa, Homo sapiens; identical to SEQ ID NO: 41952

SEQ ID NO: 41954 - protein, 584 aa, Homo sapiens
GHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRSCHLPCELFGR

SEQ ID NO: 41955 - protein, 444 aa, Homo sapiens
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGF

SEQ ID NO: 41956 - protein, 569 aa, Homo sapiens
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGHRLIGHSSAECILSGNTAHWSMKPPICQQIFCPNPPAILNGRHTGTPLGDIPYGKEVSYTCDPHPDRGMTFNLIGESTIRRTSEPHGNGVWSSPAPRCELPVGAGSHDALIVGKFYEVFAEEFCHL

SEQ ID NO: 41957 - protein, 1092 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKGCQSPPGLHHGRHTGGNTVFFVSGMTVDYTCDPGYLLVGNKSIHCMPSGNWSPSAPRCEETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 41958 - protein, 1033 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 41959 - protein, 971 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 41960 - protein, 1006 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGNHLPTTPCYLQWGTHREFLRRFSIWNHGHLHMPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 41961 - protein, 282 aa, Homo sapiens
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 41962 - protein, 253 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 41963 - protein, 229 aa, Homo sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNS

SEQ ID NO: 41964 - protein, 251 aa, Homo sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 41965 - protein, 153 aa, Homo sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEP

SEQ ID NO: 41966 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 41967 - protein, 245 aa, Homo sapiens; identical to SEQ ID NO: 41966

SEQ ID NO: 41968 - protein, 245 aa, Homo sapiens; identical to SEQ ID NO: 41966

SEQ ID NO: 41969 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 41970 - protein, 287 aa, Homo sapiens
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 41971 - protein, 668 aa, Homo sapiens
MSVRFRVGREENAQWWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGIQVVAGVVDVSAGRVSWSTSSQTCCTRVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 41972 - protein, 376 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGCTPAQHRAFGRMNRRERRFLGACQCVGSP

SEQ ID NO: 41973 - protein, 653 aa, Homo sapiens
WLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGIQVVAGVVDVSAGRVSWSTSSQTCCTRVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 41974 - protein, 487 aa, Homo sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 41975 - protein, 438 aa, Homo sapiens
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDEAGESLEPGRRRLQ

SEQ ID NO: 41976 - protein, 688 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 41977 - protein, 688 aa, Homo sapiens; identical to SEQ ID NO: 41976

SEQ ID NO: 41978 - protein, 682 aa, Homo sapiens [sequence omitted]

SEQ ID NO: 41979 - protein, 168 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDM

SEQ ID NO: 41980 - protein, 688 aa, Homo sapiens; identical to SEQ ID NO: 41976

SEQ ID NO: 41981 - protein, 103 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPY

SEQ ID NO: 41982 - protein, 101 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQV

SEQ ID NO: 41983 - protein, 752 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 41984 - protein, 377 aa, Homo sapiens
MTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGGSGELGSLQPLPWLC

SEQ ID NO: 41985 - protein, 752 aa, Homo sapiens; identical to SEQ ID NO: 41983

SEQ ID NO: 41986 - protein, 525 aa, Homo sapiens
MVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 41987 - protein, 752 aa, Homo sapiens; identical to SEQ ID NO: 41983

SEQ ID NO: 41988 - protein, 525 aa, Homo sapiens; identical to SEQ ID NO: 41986

SEQ ID NO: 41989 - protein, 752 aa, Homo sapiens; identical to SEQ ID NO: 41983

SEQ ID NO: 41990 - protein, 139 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDG

SEQ ID NO: 41991 - protein, 169 aa, Homo sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGG

SEQ ID NO: 41992 - protein, 139 aa, Homo sapiens; identical to SEQ ID NO: 41990

SEQ ID NO: 41993 - protein, 752 aa, Homo sapiens; identical to SEQ ID NO: 41983

SEQ ID NO: 41994 - protein, 125 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSS

SEQ ID NO: 41995 - protein, 169 aa, Homo sapiens; identical to SEQ ID NO: 41991

SEQ ID NO: 41996 - protein, 353 aa, Homo sapiens
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIK

SEQ ID NO: 41997 - protein, 752 aa, Homo sapiens; identical to SEQ ID NO: 41983

SEQ ID NO: 41998 - protein, 353 aa, Homo sapiens; identical to SEQ ID NO: 41996

SEQ ID NO: 41999 - protein, 353 aa, Homo sapiens; identical to SEQ ID NO: 41996

SEQ ID NO: 42000 - protein, 169 aa, Homo sapiens; identical to SEQ ID NO: 41991

SEQ ID NO: 42001 - protein, 525 aa, Homo sapiens; identical to SEQ ID NO: 41986

SEQ ID NO: 42002 - protein, 353 aa, Homo sapiens; identical to SEQ ID NO: 41996

SEQ ID NO: 42003 - protein, 134 aa, Homo sapiens
  MOD_RES (1)..(1): Any amino acid
XGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMV

SEQ ID NO: 42004 - protein, 525 aa, Homo sapiens; identical to SEQ ID NO: 41986

SEQ ID NO: 42005 - protein, 525 aa, Homo sapiens; identical to SEQ ID NO: 41986

SEQ ID NO: 42006 - protein, 353 aa, Homo sapiens; identical to SEQ ID NO: 41996

SEQ ID NO: 42007 - protein, 158 aa, Homo sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMV

SEQ ID NO: 42008 - protein, 158 aa, Homo sapiens; identical to SEQ ID NO: 42007

SEQ ID NO: 42009 - protein, 325 aa, Homo sapiens
MGTRSAIAAPRILCSRGLRSGSARATGSGVERSPSAANPTLMTSLRTWPLPWALPSPTCLGPPIPPRRQRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKA

SEQ ID NO: 42010 - protein, 158 aa, Homo sapiens; identical to SEQ ID NO: 42007

SEQ ID NO: 42011 - protein, 353 aa, Homo sapiens; identical to SEQ ID NO: 41996

SEQ ID NO: 42012 - protein, 139 aa, Homo sapiens; identical to SEQ ID NO: 41990

SEQ ID NO: 42013 - protein, 145 aa, Homo sapiens
  MOD_RES (1)..(1): Any amino acid
XGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGG

SEQ ID NO: 42014 - protein, 125 aa, Homo sapiens; identical to SEQ ID NO: 41994

SEQ ID NO: 42015 - protein, 139 aa, Homo sapiens; identical to SEQ ID NO: 41990

SEQ ID NO: 42016 - protein, 158 aa, Homo sapiens; identical to SEQ ID NO: 42007

SEQ ID NO: 42017 - protein, 125 aa, Homo sapiens; identical to SEQ ID NO: 41994

SEQ ID NO: 42018 - protein, 620 aa, Homo sapiens
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 42019 - protein, 125 aa, Homo sapiens; identical to SEQ ID NO: 41994

SEQ ID NO: 42020 - protein, 139 aa, Homo sapiens; identical to SEQ ID NO: 41990

SEQ ID NO: 42021 - protein, 125 aa, Homo sapiens; identical to SEQ ID NO: 41994

SEQ ID NO: 42022 - protein, 752 aa, Homo sapiens; identical to SEQ ID NO: 41983

SEQ ID NO: 42023 - protein, 125 aa, Homo sapiens; identical to SEQ ID NO: 41994

SEQ ID NO: 42024 - protein, 169 aa, Homo sapiens; identical to SEQ ID NO: 41991

SEQ ID NO: 42025 - protein, 525 aa, Homo sapiens; identical to SEQ ID NO: 41986

SEQ ID NO: 42026 - protein, 145 aa, Homo sapiens; identical to SEQ ID NO: 42013
  MOD_RES (1)..(1): Any amino acid

SEQ ID NO: 42027 - protein, 134 aa, Homo sapiens; identical to SEQ ID NO: 42003
  MOD_RES (1)..(1): Any amino acid

SEQ ID NO: 42028 - protein, 139 aa, Homo sapiens; identical to SEQ ID NO: 41990

SEQ ID NO: 42029 - protein, 139 aa, Homo sapiens; identical to SEQ ID NO: 41990

SEQ ID NO: 42030 - protein, 538 aa, Homo sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 42031 - protein, 506 aa, Homo sapiens
MGTRSAIAAPRILCSRGLRSGSARATGSGVERSPSAAIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 42032 - protein, 506 aa, Homo sapiens; identical to SEQ ID NO: 42031

SEQ ID NO: 42033 - protein, 506 aa, Homo sapiens; identical to SEQ ID NO: 42031

SEQ ID NO: 42034 - protein, 377 aa, Homo sapiens; identical to SEQ ID NO: 41984

SEQ ID NO: 42035 - protein, 325 aa, Homo sapiens; identical to SEQ ID NO: 42009

SEQ ID NO: 42036 - protein, 506 aa, Homo sapiens; identical to SEQ ID NO: 42031

SEQ ID NO: 42037 - protein, 506 aa, Homo sapiens; identical to SEQ ID NO: 42031

SEQ ID NO: 42038 - protein, 538 aa, Homo sapiens; identical to SEQ ID NO: 42030

SEQ ID NO: 42039 - protein, 377 aa, Homo sapiens; identical to SEQ ID NO: 41984

SEQ ID NO: 42040 - protein, 620 aa, Homo sapiens; identical to SEQ ID NO: 42018

SEQ ID NO: 42041 - protein, 620 aa, Homo sapiens; identical to SEQ ID NO: 42018

SEQ ID NO: 42042 - protein, 325 aa, Homo sapiens; identical to SEQ ID NO: 42009

SEQ ID NO: 42043 - protein, 325 aa, Homo sapiens; identical to SEQ ID NO: 42009

SEQ ID NO: 42044 - protein, 506 aa, Homo sapiens; identical to SEQ ID NO: 42031

SEQ ID NO: 42045 - protein, 325 aa, Homo sapiens; identical to SEQ ID NO: 42009

SEQ ID NO: 42046 - protein, 620 aa, Homo sapiens; identical to SEQ ID NO: 42018

SEQ ID NO: 42047 - protein, 377 aa, Homo sapiens; identical to SEQ ID NO: 41984

SEQ ID NO: 42048 - protein, 377 aa, Homo sapiens; identical to SEQ ID NO: 41984

SEQ ID NO: 42049 - protein, 325 aa, Homo sapiens; identical to SEQ ID NO: 42009

SEQ ID NO: 42050 - protein, 377 aa, Homo sapiens; identical to SEQ ID NO: 41984

SEQ ID NO: 42051 - protein, 538 aa, Homo sapiens; identical to SEQ ID NO: 42030

SEQ ID NO: 42052 - protein, 620 aa, Homo sapiens; identical to SEQ ID NO: 42018

SEQ ID NO: 42053 - protein, 620 aa, Homo sapiens; identical to SEQ ID NO: 42018

SEQ ID NO: 42054 - protein, 620 aa, Homo sapiens; identical to SEQ ID NO: 42018

SEQ ID NO: 42055 - protein, 325 aa, Homo sapiens; identical to SEQ ID NO: 42009

SEQ ID NO: 42056 - protein, 377 aa, Homo sapiens; identical to SEQ ID NO: 41984

SEQ ID NO: 42057 - protein, 538 aa, Homo sapiens; identical to SEQ ID NO: 42030

SEQ ID NO: 42058 - protein, 538 aa, Homo sapiens; identical to SEQ ID NO: 42030

SEQ ID NO: 42059 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 42060 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 42061 - protein, 152 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTS

SEQ ID NO: 42062 - protein, 252 aa, Homo sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 42063 - protein, 251 aa, Homo sapiens
MFFWCACCLMVAWRVSASDEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 42064 - protein, 252 aa, Homo sapiens; identical to SEQ ID NO: 42062

SEQ ID NO: 42065 - protein, 252 aa, Homo sapiens; identical to SEQ ID NO: 42062

SEQ ID NO: 42066 - protein, 218 aa, Homo sapiens
MVAWRVSASDEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSIPQTRPLPFQPCSPLFLFLLRQSLALFPRLECSGRILAHCNLHLPGSSSSHASASQVAGITGAHPRWANFCIFSRDWVSPCWPGWSQIPDLR

SEQ ID NO: 42067 - protein, 181 aa, Homo sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVD

SEQ ID NO: 42068 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIEWPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42069 - protein, 1744 aa, Homo sapiens [sequence omitted]

SEQ ID NO: 42070 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42071 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42072 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42073 - protein, 270 aa, Homo sapiens
MCPEDSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGG

SEQ ID NO: 42074 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIEWPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42075 - protein, 511 aa, Homo sapiens
MAKGLSVQNDKHPGYQPALLLSPGAPLFADGPAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42076 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42077 - protein, 1698 aa, Homo sapiens [sequence omitted]

SEQ ID NO: 42078 - protein, 511 aa, Homo sapiens; identical to SEQ ID NO: 42075

SEQ ID NO: 42079 - protein, 270 aa, Homo sapiens
MCPEDSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGG

SEQ ID NO: 42080 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42081 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42082 - protein, 1744 aa, Homo sapiens; identical to SEQ ID NO: 42080

SEQ ID NO: 42083 - protein, 1744 aa, Homo sapiens [sequence omitted]

SEQ ID NO: 42084 - protein, 268 aa, Homo sapiens
MCPEDSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESP

SEQ ID NO: 42085 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42086 - protein, 270 aa, Homo sapiens; identical to SEQ ID NO: 42073

SEQ ID NO: 42087 - protein, 1698 aa, Homo sapiens; identical to SEQ ID NO: 42081

SEQ ID NO: 42088 - protein, 511 aa, Homo sapiens; identical to SEQ ID NO: 42075

SEQ ID NO: 42089 - protein, 650 aa, Homo sapiens
MGSQCRGWHMCALGSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 42090 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 42091 - protein, 1105 aa, Homo sapiens
GRAGEVRALSSGAQRRGSHFVVLCRLPRGRARVVGASLSHAPLPLRYCWKGRGGVSRLFCSQRARMPGSLGREASGRAGPTGCGAFAFGLRCRYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFPGNRKSLEHFSF

SEQ ID NO: 42092 - protein, 934 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 42093 - protein, 934 aa, Homo sapiens; identical to SEQ ID NO: 42092

SEQ ID NO: 42094 - protein, 843 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 42095 - protein, 486 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQNGKISNWMKVNETLLVEHH

SEQ ID NO: 42096 - protein, 343 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEKKKKKKKKKK

SEQ ID NO: 42097 - protein, 584 aa, Homo sapiens
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 42098 - protein, 591 aa, Homo sapiens
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 42099 - protein, 529 aa, Homo sapiens
MDTCMTLAFTLSGRFFMLLSQYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 42100 - protein, 539 aa, Homo sapiens
MRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 42101 - protein, 202 aa, Homo sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 42102 - protein, 164 aa, Homo sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYGAQGVVTDRPGVG

SEQ ID NO: 42103 - protein, 559 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 42104 - protein, 589 aa, Homo sapiens
MGSNLSPQLCLMPFILGLLSGGVTTTPWSLAQPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYG

SEQ ID NO: 42105 - protein, 589 aa, Homo sapiens; identical to SEQ ID NO: 42104

SEQ ID NO: 42106 - protein, 764 aa, Homo sapiens [sequence omitted]

SEQ ID NO: 42107 - protein, 764 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 42108 - protein, 764 aa, Homo sapiens; identical to SEQ ID NO: 42107

SEQ ID NO: 42109 - protein, 764 aa, Homo sapiens [sequence omitted]

SEQ ID NO: 42110 - protein, 764 aa, Homo sapiens; identical to SEQ ID NO: 42107

SEQ ID NO: 42111 - protein, 764 aa, Homo sapiens; identical to SEQ ID NO: 42107

SEQ ID NO: 42112 - protein, 764 aa, Homo sapiens; identical to SEQ ID NO: 42107

SEQ ID NO: 42113 - protein, 764 aa, Homo sapiens; identical to SEQ ID NO: 42107

SEQ ID NO: 42114 - protein, 764 aa, Homo sapiens; identical to SEQ ID NO: 42107

SEQ ID NO: 42115 - protein, 764 aa, Homo sapiens; identical to SEQ ID NO: 42107

SEQ ID NO: 42116 - protein, 764 aa, Homo sapiens; identical to SEQ ID NO: 42107

SEQ ID NO: 42117 - protein, 144 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRT

SEQ ID NO: 42118 - protein, 1266 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 42119 - protein, 1266 aa, Homo sapiens
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKEEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 42120 - protein, 1266 aa, Homo sapiens; identical to SEQ ID NO: 42118

SEQ ID NO: 42121 - protein, 1266 aa, Homo sapiens; identical to SEQ ID NO: 42118

SEQ ID NO: 42122 - protein, 1266 aa, Homo sapiens; identical to SEQ ID NO: 42118

SEQ ID NO: 42123 - protein, 1266 aa, Homo sapiens; identical to SEQ ID NO: 42118

SEQ ID NO: 42124 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 42125 - protein, 330 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 42126 - protein, 270 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 42127 - protein, 270 aa, Homo sapiens; identical to SEQ ID NO: 42126

SEQ ID NO: 42128 - protein, 330 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 42129 - protein, 195 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSDMVFCISY

SEQ ID NO: 42130 - protein, 269 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVNSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 42131 - protein, 331 aa, Homo sapiens
MLLLINVILTLWVSCANGQEVKPCDFPEIQHGGLYYKSLRRLYFPAAAGQSYSYYCDQNFVTPSGSYWDYIHCTQDGWSPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 42132 - protein, 577 aa, Homo sapiens
MLLLINVILTLWVSCANGQVKPCDFPEIQHGGLYYKSLRRLYFPAAAGQSYSYYCDQNFVTPSGSYWDYIHCTQDGWSPTVPCLRTCSKSDVEIENGFISESSSIYILNEETQYNCKPGYATAEGNSSGSITCLQNGWSTQPICIKFCDMPVFENSRAKSNGMWFKLHDTLDYECYDGYESSYGNTTDSIVCGEDGWSHLPTCYNSSENCGPPPPISNGDTTSFPQKVYLPWSRVEYQCQSYYELQGSKYVTCSNGDWSEPPRCISMKPCEFPEIQHGHLYYENTRRPYFPVATGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 42133 - protein, 331 aa, Homo sapiens
MLLLINVILTLWVSCANGQAMKPCEFPEIQHGHLYYENTRRPYFPVATGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 42134 - protein, 331 aa, Homo sapiens
MLLLINVILTLWVSCANGQEVKPCDFPEIQHGGLYYKSLRRLYFPAAAGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 42135 - protein, 583 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 42136 - protein, 591 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAAARHPTIQGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 42137 - protein, 576 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 42138 - protein, 321 aa, Homo sapiens
QVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAAFAELCIEETEILTADMDAERRRIKSLLPKLSCGVKNRMHIRRKR

SEQ ID NO: 42139 - protein, 377 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGKMKQISLDIFKGLHRVYAILEFCCIILK

SEQ ID NO: 42140 - protein, 134 aa, Homo sapiens
MEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 42141 - protein, 134 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 42142 - protein, 134 aa, Homo sapiens; identical to SEQ ID NO: 42141

SEQ ID NO: 42143 - protein, 184 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALRGRGGGGRGEHPGHGAQIPARAAAGHVQEVTRPPAPAYSTCYYFFLVLSFLFIRLSLNSEGENLSWPLPLFPGQGLLPLSSPSHLPSSQGIHLHPTPK

SEQ ID NO: 42144 - protein, 77 aa, Homo sapiens
MDFVMKQALGGATKDMGKMLGGEEEKDPDAQKKEEERQEALRQQEEERKAKHARMEAEREKVRQQIRDKYGLKKKEE

SEQ ID NO: 42145 - protein, 111 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEE

SEQ ID NO: 42146 - protein, 119 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDT

SEQ ID NO: 42147 - protein, 37 aa, Homo sapiens
MDFVMKQALGGATKDMGKMLGGEEEKDPDAQKKEEER

SEQ ID NO: 42148 - protein, 134 aa, Homo sapiens; identical to SEQ ID NO: 42141

SEQ ID NO: 42149 - protein, 6 aa, Homo sapiens
MDFVMK

SEQ ID NO: 42150 - protein, 980 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 42151 - protein, 940 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQYDANC

SEQ ID NO: 42152 - protein, 737 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 42153 - protein, 738 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 42154 - protein, 679 aa, Homo sapiens
MVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 42155 - protein, 622 aa, Homo sapiens
MSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 42156 - protein, 427 aa, Homo sapiens
MGFAMEDTEDISQNHFGHLCIFKWGHWKKDLKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 42157 - protein, 828 aa, Homo sapiens
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKEISLDLKKTRDAAFKILNPMTVPRFFRLNSNNALIEFLLEGTPEIREHYLDSKKDVDRHLKSACEQFIQQQTKLFVEQLEEFMTKVSALKTMASQGGPKYTLSQQPWAQPAKVNDLAATAYKTIKTKLPVTLRSMSLYLSNKDTEFILFKPVRNNIQQVFQKFHALLKEEFSPEDIQIIACPSMEQLSLLLLVSK

SEQ ID NO: 42158 - protein, 789 aa, Homo sapiens
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 42159 - protein, 764 aa, Homo sapiens
MADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLSDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 42160 - protein, 337 aa, Homo sapiens
MADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQNFVFSFF

SEQ ID NO: 42161 - protein, 447 aa, Homo sapiens
MRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 42162 - protein, 860 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 42163 - protein, 839 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 42164 - protein, 823 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIR

SEQ ID NO: 42165 - protein, 688 aa, Homo sapiens
MRGRFAHAQYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 42166 - protein, 615 aa, Homo sapiens
MAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKRPPNGP

SEQ ID NO: 42167 - protein, 657 aa, Homo sapiens
MAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 42168 - protein, 770 aa, Homo sapiens
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYDALLGAWHTQIQWATQVFQKPHEVVMVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTRPEDYRQVSKGLPRRLATTVATMRSVNY

SEQ ID NO: 42169 - protein, 612 aa, Homo sapiens
MATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 42170 - protein, 299 aa, Homo sapiens [sequence omitted]

SEQ ID NO: 42171 - protein, 326 aa, Homo sapiens
MMAYMNPGPHYSVNALALSGPSVDLMHQAVPYPSPPLALDPPRRQRQERTVYTESQQKVLEFYFQKDQYPNYDQRLNLAEMLSLREQQLQVWFKNRRAKLARERRLQQQPQRVPGQRGRGARAAPLVPVAAASFPGGPEFPQGRGSWISPQPGPWGVLPAAEPKIYSLPRTWGGPECGTQEGLKAVPAPGPGPIPAPIPGPAQIPGPVPGPAPNLGPMSGPLSVSIPGPIPAPISCPGPIPDPVLGRTLMPGPGSLPTPAPGALWPQSPYASNLSPDTQLYPDFTKLLPLLDRFEESSLSTTTSQYKEEDGFVDKNHSVPRSLLDL

SEQ ID NO: 42172 - protein, 299 aa, Homo sapiens [sequence omitted]

SEQ ID NO: 42173 - protein, 299 aa, Homo sapiens [sequence omitted]

SEQ ID NO: 42174 - protein, 299 aa, Homo sapiens [sequence omitted]

SEQ ID NO: 42175 - protein, 1225 aa, Homo sapiens
MAAVLESLLREEVSVAAVVRWIARSTQGSEDNAGEAAALSSLRALRKEFVPFLLNFLREQSSRVLPQGPPTPAKTPGASAALPGRPGGPPRGSRGARSQLFPPTEAQSTAAEAPLARRGGRRRGPGPARERGGRGLEEGVSGESLPGAGGRRLRGSGSPSRPSLTLSDPPNLSNLEEFPPVGSVPPGPTETQLSCRRWVPRRLWGVSHSSSALRSGAPGCRTKPSRRINPTPVSEERSLSKPKTCFTSPPISCVPSSKQLQQSPTPTCPTPELGSPLPSRTGSLTDEPADPARVSSRQRLELVALVYSSCIAENLVPNLFLELFFVFQLLTARRMVTAKDSDPELSPAVLDSLESPLFQSIHDCVFFAVQVLECHFQVLSNLDKGTLKLLAENERLLCFSPALQGRLRAAYEGSVAKVSLVMPPSTQAVSFQPETDNRANFSSDRAFHTFKKQRDVFYEVLREWEDHHEEPGWDFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 42176 - protein, 1227 aa, Homo sapiens
MAAVLESLLREEVSVAAVVRWIARSTQGSEDNAGEAAALSSLRALRKEFVPFLLNFLREQSSRVLPQGPPTPAKTPGASAALPGRPGGPPRGSRGARSQLFPPTEAQSTAAEAPLARRGGRRRGPGPARERGGRGLEEGVSGESLPGAGGRRLRGSGSPSRPSLTLSDPPNLSNLEEFPPVGSVPPGPTGTKPSRRINPTPVSEERSLSKPKTCFTSPPISCVPSSQPSALDTSPWGLGLPPGCRSLQEEREMLRKERSKQLQQSPTPTCPTPELGSPLPSRTGSLTDEPADPARVSSRQRLELVALVYSSCIAENLVPNLFLELFFVFQLLTARRMVTAKDSDPELSPAVLDSLESPLFQSIHDCVFFAVQVLECHFQVLSNLDKGTLKLLAENERLLCFSPALQGRLRAAYEGSVAKVSLVMPPSTQAVSFQPETDNRANFSSDRAFHTFKKQRDVFYEVLREWEDHHEEPGWDFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 42177 - protein, 898 aa, Homo sapiens
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 42178 - protein, 1034 aa, Homo sapiens
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 42179 - protein, 1004 aa, Homo sapiens
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 42180 - protein, 849 aa, Homo sapiens
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 42181 - protein, 137 aa, Homo sapiens
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPDSRILFPGGGL

SEQ ID NO: 42182 - protein, 616 aa, Homo sapiens
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVNQR

SEQ ID NO: 42183 - protein, 725 aa, Homo sapiens
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQDEVGGGSCILLVLLCIATVFLSVGGTALYCTFGDMESPVCTDFADNMDFYYTKLLQGVAELKHWIYLS

SEQ ID NO: 42184 - protein, 1018 aa, Homo sapiens
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 42185 - protein, 1007 aa, Homo sapiens
MKMWLLVSHLVIISITTCLAVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 42186 - protein, 627 aa, Homo sapiens
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGKNRKGGEKNMVDSFLPVCASLPPTW

SEQ ID NO: 42187 - protein, 627 aa, Homo sapiens; identical to SEQ ID NO: 42186

SEQ ID NO: 42188 - protein, 627 aa, Homo sapiens; identical to SEQ ID NO: 42186

SEQ ID NO: 42189 - protein, 85 aa, Homo sapiens
MKMWLLVSHLVIISITTCLAEFTWYRRYGHGVSEEDKGFGPIFEEQPINTIYPEESLEGKVSLNCRARASPFPVYKWRMNNGDVD

SEQ ID NO: 42190 - protein, 1018 aa, Homo sapiens; identical to SEQ ID NO: 42184

SEQ ID NO: 42191 - protein, 63 aa, Homo sapiens
MKMWLLVSHLVIISITTCLAEFTWYRRYGHGVSEEDKGFGPIFEEQPINTIYPEESLEGKVSL

SEQ ID NO: 42192 - protein, 90 aa, Homo sapiens
MKMWLLVSHLVIISITTCLAEFTWYRRYGHGVSEEDKGFGPIFEEQPINTIYPEESLEGKVSLNCRARASPFPVYKWRMNNGDVDLTSDR

SEQ ID NO: 42193 - protein, 73 aa, Homo sapiens
MKMWLLVSHLVIISITTCLAEFTWYRRYGHGVSEEDKGFGPIFEEQPINTIYPEESLEGKVSLNCRARASPFP

SEQ ID NO: 42194 - protein, 1040 aa, Homo sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 42195 - protein, 1028 aa, Homo sapiens
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 42196 - protein, 807 aa, Homo sapiens
MGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 42197 - protein, 698 aa, Homo sapiens
MEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 42198 - protein, 1026 aa, Homo sapiens
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 42199 - protein, 1026 aa, Homo sapiens; identical to SEQ ID NO: 42198

SEQ ID NO: 42200 - protein, 116 aa, Homo sapiens
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKL

SEQ ID NO: 42201 - protein, 1026 aa, Homo sapiens; identical to SEQ ID NO: 42198

SEQ ID NO: 42202 - protein, 698 aa, Homo sapiens; identical to SEQ ID NO: 42197

SEQ ID NO: 42203 - protein, 54 aa, Homo sapiens
MRLPWELLVLQSFILCLADDSTLHGPIFIQEPSPVMFPLDSEEKKVKLNCEVKG

SEQ ID NO: 42204 - protein, 1100 aa, Homo sapiens
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 42205 - protein, 1026 aa, Homo sapiens
MASSWKLMLFLSVTMCLSESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 42206 - protein, 1100 aa, Homo sapiens; identical to SEQ ID NO: 42204

SEQ ID NO: 42207 - protein, 1100 aa, Homo sapiens; identical to SEQ ID NO: 42204

SEQ ID NO: 42208 - protein, 911 aa, Homo sapiens
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEV

SEQ ID NO: 42209 - protein, 1028 aa, Homo sapiens
MRLLWKLVILLPLINSSAGDGLLSRPIFTQEPHDVIFPLDLSKSEVILNCAANGYPSPHYRWKQNGTDIDFTMSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 42210 - protein, 1028 aa, Homo sapiens; identical to SEQ ID NO: 42209

SEQ ID NO: 42211 - protein, 956 aa, Homo sapiens
MSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 42212 - protein, 1331 aa, Homo sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 42213 - protein, 390 aa, Homo sapiens
MNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 42214 - protein, 450 aa, Homo sapiens
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQNSDFLCQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 42215 - protein, 443 aa, Homo sapiens
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 42216 - protein, 423 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 42217 - protein, 319 aa, Homo sapiens [sequence omitted]

SEQ ID NO: 42218 - protein, 277 aa, Homo sapiens
ASPFWVSWLYGSPLPAPPLPGGARSGTCAPILVLQNAAEALARQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFI

SEQ ID NO: 42219 - protein, 403 aa, Homo sapiens
MTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 42220 - protein, 537 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 42221 - protein, 139 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNR

SEQ ID NO: 42222 - protein, 9 aa, Homo sapiens
MAAQCVTKV

SEQ ID NO: 42223 - protein, 537 aa, Homo sapiens; identical to SEQ ID NO: 42220

SEQ ID NO: 42224 - protein, 79 aa, Homo sapiens
MAAQCVTKVALNVSCANLLDKDIGSKSDPLCVLFLNTSGQQWYEVERTERIKNCLNPQFSKTFIIDYYFEVVQKLKFGV

SEQ ID NO: 42225 - protein, 135 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEI

SEQ ID NO: 42226 - protein, 234 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMT

SEQ ID NO: 42227 - protein, 153 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNK

SEQ ID NO: 42228 - protein, 593 aa, Homo sapiens
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNPKKKMKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 42229 - protein, 301 aa, Homo sapiens
MKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 42230 - protein, 557 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 42231 - protein, 557 aa, Homo sapiens; identical to SEQ ID NO: 42230

SEQ ID NO: 42232 - protein, 612 aa, Homo sapiens
MAFKEHGKITSCCIPGPINSSRAGAGAGASGWSSKGVRARAREPERGAPDREPSDMSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 42233 - protein, 52 aa, Homo sapiens
MSDPEMGWVPEPPTMTLGASRVELRVSCHGLLDRDTLTKPHPCVLLKLYSDE

SEQ ID NO: 42234 - protein, 131 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKN

SEQ ID NO: 42235 - protein, 226 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFL

SEQ ID NO: 42236 - protein, 105 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDT

SEQ ID NO: 42237 - protein, 141 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTIT

SEQ ID NO: 42238 - protein, 149 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSG

SEQ ID NO: 42239 - protein, 633 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQPAQKWLLQVVMRVSVDVLGPAGHCAKHFLCCTESSHLARTGPSFLLRYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 42240 - protein, 558 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 42241 - protein, 274 aa, Homo sapiens
MASDSGNQGTLCTLEFAVQMTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 42242 - protein, 454 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 42243 - protein, 363 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 42244 - protein, 309 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEVSLEILLLCQYLD

SEQ ID NO: 42245 - protein, 100 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNL

SEQ ID NO: 42246 - protein, 131 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPA

SEQ ID NO: 42247 - protein, 363 aa, Homo sapiens; identical to SEQ ID NO: 42243

SEQ ID NO: 42248 - protein, 182 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEVRVSQLLAVTGKKTTRP

SEQ ID NO: 42249 - protein, 187 aa, Homo sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEARRQQDPSPGSNLGGGDDLKLR

SEQ ID NO: 42250 - protein, 595 aa, Homo sapiens
MVGVPGAAAFQLGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 42251 - protein, 604 aa, Homo sapiens
MAKESGISLKEIQVLARQWKVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 42252 - protein, 604 aa, Homo sapiens; identical to SEQ ID NO: 42251

SEQ ID NO: 42253 - protein, 263 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPESCIIHLKSMGVASRHEYFSGTLQMPAHPVRNSTLENLWVDCSRSLRSTVLPFP

SEQ ID NO: 42254 - protein, 575 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 42255 - protein, 378 aa, Homo sapiens
MEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 42256 - protein, 181 aa, Homo sapiens
MVGVPGAAAFQLGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELL

SEQ ID NO: 42257 - protein, 80 aa, Homo sapiens
MAKESGISLKEIQVLARQWKVGPEKRVPAMPGSPVEVKIQSRSSPPTMPPLPPINPGGPRPVSFTPTALSNGINHSPPTL

SEQ ID NO: 42258 - protein, 152 aa, Homo sapiens
MSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 42259 - protein, 653 aa, Homo sapiens
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 42260 - protein, 567 aa, Homo sapiens
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 42261 - protein, 567 aa, Homo sapiens; identical to SEQ ID NO: 42260

SEQ ID NO: 42262 - protein, 615 aa, Homo sapiens
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPERYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 42263 - protein, 577 aa, Homo sapiens
MPASRLRDRAASSASGSTCGSMSQTHPVLESGLLASAGCSAPRGPRKGGPVMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 42264 - protein, 112 aa, Homo sapiens
MSYPVTSQPQCATTSCYQTQLSDWHTGLTDCCNDMPVCLCGTFAPLCLACRISDDFGECCCAPYLPGGLHSIRTGMRERYHIQGSVGHDWAALTFCLPCALCQMARELKIRE

SEQ ID NO: 42265 - protein, 1048 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 42266 - protein, 925 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 42267 - protein, 367 aa, Homo sapiens
MNRFRVSKFRHTEARPPRREDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLEMREKRHREV

SEQ ID NO: 42268 - protein, 840 aa, Homo sapiens
MNRFRVSKFRHTEARPPRRESWISDIRAGTAPSCRNHIKSSCSLIAFNSDRPGVLGIVPLQGQGEDKRRVAHLGCHSELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 42269 - protein, 705 aa, Homo sapiens
MGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 42270 - protein, 461 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 42271 - protein, 480 aa, Homo sapiens
MTVTKMSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 42272 - protein, 461 aa, Homo sapiens; identical to SEQ ID NO: 42270

SEQ ID NO: 42273 - protein, 489 aa, Homo sapiens
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 42274 - protein, 287 aa, Homo sapiens
CFLLPRGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPGVRRFCLA

SEQ ID NO: 42275 - protein, 489 aa, Homo sapiens; identical to SEQ ID NO: 42273

SEQ ID NO: 42276 - protein, 289 aa, Homo sapiens [sequence omitted]

SEQ ID NO: 42277 - protein, 183 aa, Homo sapiens
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGLHRPPFCAPPPHGPLHTSQQPLQGPHDKWES

SEQ ID NO: 42278 - protein, 474 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 42279 - protein, 527 aa, Homo sapiens
MYGPGSQLGKSGNNSWAKERGCSIACQGSLTSARLHAPSIGERPLSHMRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 42280 - protein, 474 aa, Homo sapiens; identical to SEQ ID NO: 42278

SEQ ID NO: 42281 - protein, 162 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGT

SEQ ID NO: 42282 - protein, 165 aa, Homo sapiens
SKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 42283 - protein, 181 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVS

SEQ ID NO: 42284 - protein, 480 aa, Homo sapiens
MRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 42285 - protein, 169 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINL

SEQ ID NO: 42286 - protein, 151 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGG

SEQ ID NO: 42287 - protein, 163 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTG

SEQ ID NO: 42288 - protein, 525 aa, Homo sapiens
MSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPRWAAEHRLEEKKTWLTNGFDVFECPPPKTENELLQMFYRQQEEIRRLRELLTQREVQAKQLELEIKNLRMGSEQL

SEQ ID NO: 42289 - protein, 525 aa, Homo sapiens; identical to SEQ ID NO: 42288

SEQ ID NO: 42290 - protein, 480 aa, Homo sapiens; identical to SEQ ID NO: 42271

SEQ ID NO: 42291 - protein, 475 aa, Homo sapiens
MSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 42292 - protein, 475 aa, Homo sapiens; identical to SEQ ID NO: 42291

SEQ ID NO: 42293 - protein, 1663 aa, Homo sapiens
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 42294 - protein, 82 aa, Homo sapiens
MSATWTLSPEPLPPSTGPPVGAGLDAEQRTVFAFVLCLLVVLVLLMVRCVRILLDPYSRMPASSWTDHKEALERGQFDYALV

SEQ ID NO: 42295 - protein, 322 aa, Homo sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 42296 - protein, 240 aa, Homo sapiens
MSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 42297 - protein, 415 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 42298 - protein, 285 aa, Homo sapiens
MVSATIPQKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRASLCLCSTVSSIVRSVLPSGRGGTGGRTSTRSVPEWPVPCPSPPPQPVSAFTASSSPQQSELAGHGAAPKELWLGG

SEQ ID NO: 42299 - protein, 401 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 42300 - protein, 375 aa, Homo sapiens
MGGHPQLRLVKALLLLGLNPVSASLQDQHCESLSLASNISDNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 42301 - protein, 444 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 42302 - protein, 37 aa, Homo sapiens
VYTDYIYFNSFLESFQGFFVSVFYCFLNSEVRSAIRK

SEQ ID NO: 42303 - protein, 401 aa, Homo sapiens; identical to SEQ ID NO: 42299

SEQ ID NO: 42304 - protein, 397 aa, Homo sapiens
MGREPWPEDRDLGFPQLFCQGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 42305 - protein, 438 aa, Homo sapiens
MRGPSGPPGLLYVPHLLLCLLCLLPPPLQYAAGQSQMPKDQPLWALLEQYCHTIMTLTNLSGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 42306 - protein, 411 aa, Homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 42307 - protein, 370 aa, Homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEGLEPV

SEQ ID NO: 42308 - protein, 155 aa, Homo sapiens
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 42309 - protein, 105 aa, Homo sapiens
MPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 42310 - protein, 443 aa, Homo sapiens
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTALVVSTTAAGFALAPGPFDWPCFLLTSVGTGLASCAANSINQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 42311 - protein, 132 aa, Homo sapiens
  MOD_RES (1)..(1): Any amino acid
XRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTGTLFF

SEQ ID NO: 42312 - protein, 251 aa, Homo sapiens
MICQEFWLDYPKSNSQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 42313 - protein, 226 aa, Homo sapiens
MNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 42314 - protein, 276 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 42315 - protein, 410 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 42316 - protein, 388 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQGPVLFNFTFKISDLDEGIRNI

SEQ ID NO: 42317 - protein, 63 aa, Homo sapiens
MPGLVDSNPAPPESQEKKPLKPCCACPETKKARDACIIEKGEEHCGHLIEAHKECMRALGFKI

SEQ ID NO: 42318 - protein, 63 aa, Homo sapiens; identical to SEQ ID NO: 42317

SEQ ID NO: 42319 - protein, 98 aa, Homo sapiens
MPGLVDSNPAPPESQEKKPLKPCCACPETKKARDAWFRGRVSVDLSRSLVPGNDGERGERQASTTHSFLQIIIEKGEEHCGHLIEAHKECMRALGFKI

SEQ ID NO: 42320 - protein, 63 aa, Homo sapiens; identical to SEQ ID NO: 42317

SEQ ID NO: 42321 - protein, 365 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 42322 - protein, 324 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAASNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 42323 - protein, 200 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 42324 - protein, 252 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 42325 - protein, 352 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 42326 - protein, 89 aa, Homo sapiens
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 42327 - protein, 299 aa, Homo sapiens
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 42328 - protein, 224 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 42329 - protein, 102 aa, Homo sapiens
MEKLLCFLVLTSLSHAFGQTDMSRKAFVFPKESDTSYVSLKAPLTKPLKAFTVCLHFYTELSSTHEINTIYLGGPFSPNVLNWRALKYEVQGEVFTKPQLWP

SEQ ID NO: 42330 - protein, 102 aa, Homo sapiens; identical to SEQ ID NO: 42329

SEQ ID NO: 42331 - protein, 102 aa, Homo sapiens; identical to SEQ ID NO: 42329

SEQ ID NO: 42332 - protein, 91 aa, Homo sapiens
MEKLLCFLVLTSLSHAFGQTDMSRKAFVFPKESDTSYVSLKAPLTKPLKAFTVCLHFYTELSSTRGPNVLNWRALKYEVQGEVFTKPQLWP

SEQ ID NO: 42333 - protein, 46 aa, Homo sapiens
MWDFVLSPDEINTIYLGGPFSPNVLNWRALKYEVQGEVFTKPQLWP

SEQ ID NO: 42334 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 42335 - protein, 346 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPPRGAPRIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 42336 - protein, 217 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGI

SEQ ID NO: 42337 - protein, 148 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASK

SEQ ID NO: 42338 - protein, 417 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 42339 - protein, 448 aa, Homo sapiens
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 42340 - protein, 417 aa, Homo sapiens; identical to SEQ ID NO: 42338

SEQ ID NO: 42341 - protein, 254 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVVVGIK

SEQ ID NO: 42342 - protein, 417 aa, Homo sapiens; identical to SEQ ID NO: 42338

SEQ ID NO: 42343 - protein, 146 aa, Homo sapiens
MPVKVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDCVGELGGRT

SEQ ID NO: 42344 - protein, 168 aa, Homo sapiens
MKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDYVGELGGRT

SEQ ID NO: 42345 - protein, 103 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIK

SEQ ID NO: 42346 - protein, 129 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQER

SEQ ID NO: 42347 - protein, 338 aa, Homo sapiens
MAGPFSRLLSARPGLRLLALAGAGSLAAGFCSDRNLYELPVNDGGCIPREQSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDYVGELGGRT

SEQ ID NO: 42348 - protein, 417 aa, Homo sapiens; identical to SEQ ID NO: 42338

SEQ ID NO: 42349 - protein, 257 aa, Homo sapiens
MVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVVVGIK

SEQ ID NO: 42350 - protein, 241 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMA

SEQ ID NO: 42351 - protein, 419 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 42352 - protein, 419 aa, Homo sapiens; identical to SEQ ID NO: 42351

SEQ ID NO: 42353 - protein, 419 aa, Homo sapiens; identical to SEQ ID NO: 42351

SEQ ID NO: 42354 - protein, 170 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRS

SEQ ID NO: 42355 - protein, 381 aa, Homo sapiens
MPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 42356 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 42357 - protein, 977 aa, Homo sapiens
MHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 42358 - protein, 2404 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 42359 - protein, 2472 aa, Homo sapiens
LRGAVAVAEIWPPPPPPGLRPPSPSAPARPLAARARSSPSQPAGPPTPVRALAGPAARARGCFREQVKMAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 42360 - protein, 593 aa, Homo sapiens
MATSNNPRKFSEKIALHNQKQAEETAAFEEVMKDLSLTRAARLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQLEQFNMMENAISSSSLYSPGSTLNYSQAAMMGLTGSHGSLPDSQQLGYASHSGIPNIILTVTGESPPSLSKELTSHRGHLPDGPPVSGHAGTLPLSRPDGASPARGRPCSVPRQRPSL

SEQ ID NO: 42361 - protein, 634 aa, Homo sapiens
MATSNNPRKFSEKIALHNQKQAEETAAFEEVMKDLSLTRAARLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 42362 - protein, 650 aa, Homo sapiens
MATSNNPRKFSEKIALHNQKQAEETAAFEEVMKDLSLTRAARLQLQKSQYLQLGPSRGQYYGGSLPNVNQIGSGTMDLPFQPSGFLGEALAAAPVSLTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 42363 - protein, 693 aa, Homo sapiens
MATSGANGPGSATASASNPRKFSEKIALQKQRQAEETAAFEEVMMDIGSTRLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 42364 - protein, 619 aa, Homo sapiens
MAASPGSGSANPRKFSEKIALHTQRQAEETRAFEQLMTDLTLSRVQFQKLQQLRLTQYHGGSLPNVSQLRSSASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPEDSSTSLFKDLNSALAGLPEVSLNVDTPFPLEEELQIEPLSLDGLNMLSDSSMGLLDPSVEETFRADRL

SEQ ID NO: 42365 - protein, 618 aa, Homo sapiens
MAASPGSGSANPRKFSEKIALHTQRQAEETRAFEQLMTDLTLSRVQFQKLQQLRLTQYHGGSLPNVSQLRSSASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPDSSTSLFKDLNSALAGLPEVSLNVDTPFPLEEELQIEPLSLDGLNMLSDSSMGLLDPSVEETFRADRL

SEQ ID NO: 42366 - protein, 582 aa, Homo sapiens
MTDLTLSRVQFQKLQQLRLTQYHGGSLPNVSQLRSSASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPDSSTSLFKDLNSALAGLPEVSLNVDTPFPLEEELQIEPLSLDGLNMLSDSSMGLLDPSVEETFRADRL

SEQ ID NO: 42367 - protein, 223 aa, Homo sapiens
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 42368 - protein, 836 aa, Homo sapiens
MTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 42369 - protein, 848 aa, Homo sapiens
MTATVENLTFQKDTLGNAVDKNTSRLELRSYSLAGRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 42370 - protein, 2341 aa, Homo sapiens
MKNIYCLIPKLVNFATLGCLWISVVQCTVLNSCLKSCVTNLGQQLDLGTPHNLSEPCIQGCHFWNSVDQKNCALKCNDTYATVCERESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGASPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 42371 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 42372 - protein, 97 aa, Homo sapiens
WKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRD

SEQ ID NO: 42373 - protein, 674 aa, Homo sapiens
MTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEW

SEQ ID NO: 42374 - protein, 1406 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 42375 - protein, 941 aa, Homo sapiens
MIRNSLCQPSRCLDGYLFFNRKMFGARTHGFHILMAMLIGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGE

SEQ ID NO: 42376 - protein, 42 aa, Homo sapiens
EKDIDECASDPCVNGGLCQDLLNKFQCLCDVAFAGERCEVDY

SEQ ID NO: 42377 - protein, 1382 aa, Homo sapiens
MKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKRQTNVGRALTELGSRGPKYQVSLFRFCVGSWATGNTFFLSSIKPGSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 42378 - protein, 870 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 42379 - protein, 293 aa, Homo sapiens
MPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEAVSKTLKLIGITLPWRTSRLAHH

SEQ ID NO: 42380 - protein, 887 aa, Homo sapiens
MALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 42381 - protein, 1294 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 42382 - protein, 1176 aa, Homo sapiens
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRWDGWAGGWAANAPWGYGGAEKSARSVDESLPFPGPHVLICDMRRTV

SEQ ID NO: 42383 - protein, 953 aa, Homo sapiens
MAMEPGALWTFLGHLWLLAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 42384 - protein, 1285 aa, Homo sapiens
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 42385 - protein, 120 aa, Homo sapiens
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQVGARVPPTPNLKLPPEERLI

SEQ ID NO: 42386 - protein, 123 aa, Homo sapiens
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGCLPI

SEQ ID NO: 42387 - protein, 120 aa, Homo sapiens; identical to SEQ ID NO: 42385

SEQ ID NO: 42388 - protein, 532 aa, Homo sapiens
MPAPPGRTHTWFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 42389 - protein, 614 aa, Homo sapiens
MGGVHVAYRGGAGVAGAVWTVMAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 42390 - protein, 173 aa, Homo sapiens
MDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 42391 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 42392 - protein, 175 aa, Homo sapiens; identical to SEQ ID NO: 42391

SEQ ID NO: 42393 - protein, 174 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPK

SEQ ID NO: 42394 - protein, 175 aa, Homo sapiens; identical to SEQ ID NO: 42391

SEQ ID NO: 42395 - protein, 77 aa, Homo sapiens
MDIAIHHPWIRRPFFPFHSPSRLFDQFFGEHLLESDLFPTSTSLSPFYLRPPSFLRAPSWFDTGLSEMRLEKDRFSV

SEQ ID NO: 42396 - protein, 130 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDP

SEQ ID NO: 42397 - protein, 175 aa, Homo sapiens; identical to SEQ ID NO: 42391

SEQ ID NO: 42398 - protein, 175 aa, Homo sapiens; identical to SEQ ID NO: 42391

SEQ ID NO: 42399 - protein, 69 aa, Homo sapiens
MDIAIHHPWIRRPFFPFHSPSRLFDQFFGEHLLESDLFPTSTSLSPFYLRPPSFLRAPSWFDTGLSEMR

SEQ ID NO: 42400 - protein, 215 aa, Homo sapiens
METQAEQQELETLPTTKMAQTNPTPGSLGPWKITIYDQENFQGKRMEFTSSCPNVSERSFDNVRSLKVESGAWIGYEHTSFCGQQFILERGEYPRWDAWSGSNAYHIERLMSFRPICSANHKESKMTIFEKENFIGRQWEISDDYPSLQAMGWFNNEVGSMKIQSGAWVCYQYPGYRGYQYILECDHHGGDYKHWREWGSHAQTSQIQSIRRIQQ

SEQ ID NO: 42401 - protein, 197 aa, Homo sapiens
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 42402 - protein, 197 aa, Homo sapiens; identical to SEQ ID NO: 42401

SEQ ID NO: 42403 - protein, 129 aa, Homo sapiens
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPS

SEQ ID NO: 42404 - protein, 196 aa, Homo sapiens
MTLQCTKSAGPWKMVVWDEDGFQGRRHEFTAECPSVLELGFETVRSLKVLSGAWVGFEHAGFQGQQYILERGEYPSWDAWGGNTAYPAERLTSFRPAACANHRDSRLTIFEQENFLGKKGELSDDYPSLQAMGWEGNEVGSFHVHSGAWVCSQFPGYRGFQYVLECDHHSGDYKHFREWGSHAPTFQVQSIRRIQQ

SEQ ID NO: 42405 - protein, 252 aa, Homo sapiens
MSQAAKASASATVAVNPGPDTKGKGAPPAGTSPSPGTTLAPTTVPITSAKAAELPPGNYRLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQGDDAPSLWVYGFSDRVGSVKVSSGTWVGYQYPGYRGYQYLLEPGDFRHWNEWGAFQPQMQSLRRLRDKQWHLEGSFPVLATEPPK

SEQ ID NO: 42406 - protein, 205 aa, Homo sapiens
MASDHQTQAGKPQSLNPKIIIFEQENFQGHSHELNGPCPNLKETGVEKAGSVLVQAGPWVGYEQANCKGEQFVFEKGEYPRWDSWTSSRRTDSLSSLRPIKVDSQEHKIILYENPNFTGKKMEIIDDDVPSFHAHGYQEKVSSVRVQSGTWVGYQYPGYRGLQYLLEKGDYKDSSDFGAPHPQVQSVRRIRDMQWHQRGAFHPSN

SEQ ID NO: 42407 - protein, 211 aa, Homo sapiens
MAEQHGAPEQAAAGKSHGDLGGSYKVILYELENFQGKRCELSAECPSLTDSLLEKVGSIQVESGPWLAFESRAFRGEQFVLEKGDYPRWDAWSNSRDSDSLLSLRPLNIDSPHHKLHLFENPAFSGRKMEIVDDDVPSLWAHGFQDRVASVRAINGTWVGYEFPGYRGRQYVFERGEYRHWNEWDASQPQLQSVRRIRDQKWHKRGRFPSS

SEQ ID NO: 42408 - protein, 174 aa, Homo sapiens
MGKITFYEDRDFQGRCYNCISDCPNLRVYFSRCNSIRVDSGCWMLYERPNYQGHQYFLRRGKYPDYQHWMGLSDSVQSCRIIPHTSSHKLRLYERDDYRGLMSELTDDCACVPELFRLPEIYSLHVLEGCWVLYEMPNYRGRQYLLRPGDYRRYHDWGGADAKVGSLRRVTDLY

SEQ ID NO: 42409 - protein, 175 aa, Homo sapiens
MGKITFYEDRAFQGRSYECTTDCPNLQPYFSRCNSIRVESGCWMIYERPNYQGHQYFLRRGEYPDYQQWMGLSDSIRSCCLIPPHSGAYRMKIYDRDELRGQMSELTDDCISVQDRFHLTEIHSLNVLEGSWILYEMPNYRGRQYLLRPGEYRRFLDWGAPNAKVGSLRRVMDLY

SEQ ID NO: 42410 - protein, 174 aa, Homo sapiens
MGKITFYEDRAFQGRSYETTTDCPNLQPYFSRCNSIRVESGCWMLYERPNYQGQQYLLRRGEYPDYQQWMGLSDSIRSCCLIPQTVSHRLRLYEREDHKGLMMELSEDCPSIQDRFHLSEIRSLHVLEGCWVLYELPNYRGRQYLLRPQEYRRCQDWGAMDAKAGSLRRVVDLY

SEQ ID NO: 42411 - protein, 174 aa, Homo sapiens
MGKITLYEDRGFQGRHYECSSDHPNLQPYLSRCNSARVDSGCWMLYEQPNYSGLQYFLRRGDYADHQQWMGLSDSVRSCRLIPHSGSHRIRLYEREDYRGQMIEFTEDCSCLQDRFRFNEIHSLNVLEGSWVLYELSNYRGRQYLLMPGDYRRYQDWGATNARVGSLRRVIDFS

SEQ ID NO: 42412 - protein, 178 aa, Homo sapiens
MSKTGTKITFYEDKNFQGRRYDCDCDCADFHTYLSRCNSIKVEGGTWAVYERPNFAGYMYILPQGEYPEYQRWMGLNDRLSSCRAVHLPSGGQYKIQIFEKGDFSGQMYETTEDCPSIMEQFHMREIHSCKVLEGVWIFYELPNYRGRQYLLDKKEYRKPIDWGAASPAVQSFRRIVE

SEQ ID NO: 42413 - protein, 178 aa, Homo sapiens; identical to SEQ ID NO: 42412

SEQ ID NO: 42414 - protein, 319 aa, Homo sapiens
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 42415 - protein, 314 aa, Homo sapiens
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 42416 - protein, 314 aa, Homo sapiens; identical to SEQ ID NO: 42415

SEQ ID NO: 42417 - protein, 272 aa, Homo sapiens
MQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 42418 - protein, 314 aa, Homo sapiens; identical to SEQ ID NO: 42415

SEQ ID NO: 42419 - protein, 329 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 42420 - protein, 243 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRV

SEQ ID NO: 42421 - protein, 295 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 42422 - protein, 192 aa, Homo sapiens
MHLLSSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 42423 - protein, 329 aa, Homo sapiens; identical to SEQ ID NO: 42419

SEQ ID NO: 42424 - protein, 206 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYI

SEQ ID NO: 42425 - protein, 349 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 42426 - protein, 181 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLED

SEQ ID NO: 42427 - protein, 19 aa, Homo sapiens
MKGLYFQQSSTDEEITFVF

SEQ ID NO: 42428 - protein, 198 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 42429 - protein, 971 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 42430 - protein, 915 aa, Homo sapiens
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 42431 - protein, 569 aa, Homo sapiens
METWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKSIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 42432 - protein, 754 aa, Homo sapiens
MLSNLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 42433 - protein, 450 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 42434 - protein, 450 aa, Homo sapiens; identical to SEQ ID NO: 42433

SEQ ID NO: 42435 - protein, 450 aa, Homo sapiens; identical to SEQ ID NO: 42433

SEQ ID NO: 42436 - protein, 399 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 42437 - protein, 260 aa, Homo sapiens
MVAAPWATQEQEEGRGIQPGDRGDQKSAASQKPRSRGILHSLFCCVCRDDGEALPAHSGAPLLVEENGAIPKTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 42438 - protein, 867 aa, Homo sapiens
MEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRWTTSLEKAATTATARRGGLRSRRRSPSPGSQGPAGSGRSGHLRPARGARQGAGGPEATRGS

SEQ ID NO: 42439 - protein, 961 aa, Homo sapiens
MEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 42440 - protein, 261 aa, Homo sapiens
MDSSAVITQISKEEARGPLRGKGDQKSAASQKPRSRGILHSLFCCVCRDDGEALPAHSGAPLLVEENGAIPKQTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 42441 - protein, 975 aa, Homo sapiens
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 42442 - protein, 1184 aa, Homo sapiens
MHVNASARRWGRGGAAALPGPAASPRRPAPRTGPVGRPTLAPSPSRAHAHAKTNLLPGRAVQAPDAVPGAGSSRAPARWRPRDPGSSAPDAWQRFRPAPLRAQPRPPPRPAPGPPPPRKGGCGGQWRAPQDRTRGLRSRNSPRPPLAQPRLRHANQWRAPPGTPAADWRRPARSGRAVRDGGGGAGGSERELGLADGMEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGFSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEGMRADPGVLAALCEKTDNDIRACINTLQFLYSRGQRELSVRDVQATRVGLKDQRRGLFSVWQEVFQLPRAQRSSQHVSVLTCHGTPGDAGLVVLQDMGDAGLGLWDVLLLAWTRRGTFPGRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 42443 - protein, 1003 aa, Homo sapiens
MEDYEQELCGVEDDFHNQFAAELEVLAELEGASTPSPSGVPLFTAGRPPRTFEEALARGDAASSPAPAASVGSSQGGARKRQVDADLQPAGSLPHGRLAALPQGLRSGREAEEASGSLHVSPPAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 42444 - protein, 524 aa, Homo sapiens
MKEPRIFPRERPTPWTRAPLPPRGRLDGSLGPQGGPVLNTGHPLGVNSDPFLMAAGSLGGNLTPFPRNPSPFPASSGSLASNPAPFPAGARDPSMASFPRGMNPTGTGAVSFPRPGGLLGPGPGPGPTLNPRTGALPGPGPLSNPRLGGLPGPGPMSNPRAGGLLGAGPDPRGGGPMGPGSGPNLRAGVLLTSGNGPPNPRPVGLGPGPNPNLRSGFLGTNPAPRSGVFPGPGLGPNPRPSGLGPGPNLDARAGGLLGTGSGLNLRMAGPQGLDLAPILRAAGLLGANSASFSQASGNMGTSPSSMARVPGPMGPNSGPSSRGIGLPGPNPSPMSRAPGPIGPNSAHFSRPVGPMGVNANPFPRGAGSSAFSQSSGTLASNPATFQRSAGLQGSNPTIFPRASGPLGPNPANFPRATGLQGPSPTTFPRSTGPLGPGQVTFPRPAAGHLGPSPAGPVGINPAPFTRPTGTLGLNPASFPRMNGPAGKSFVPFPRVGSLPGTNPAAFPRPGGPMAAMYPNGMLPP

SEQ ID NO: 42445 - protein, 121 aa, Homo sapiens
MVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 42446 - protein, 121 aa, Homo sapiens; identical to SEQ ID NO: 42445

SEQ ID NO: 42447 - protein, 591 aa, Homo sapiens
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 42448 - protein, 591 aa, Homo sapiens; identical to SEQ ID NO: 42447

SEQ ID NO: 42449 - protein, 360 aa, Homo sapiens
MFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 42450 - protein, 314 aa, Homo sapiens
MPKSKSKMKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRFACNEELGVLASFTLL

SEQ ID NO: 42451 - protein, 586 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSSDRYSDASDDSFSEPRIAELEIS

SEQ ID NO: 42452 - protein, 176 aa, Homo sapiens
MYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILISLSLGLASVEHTECPSAFDLRDSLFIGLFCELPMLLEMNLDWDLD

SEQ ID NO: 42453 - protein, 586 aa, Homo sapiens; identical to SEQ ID NO: 42451

SEQ ID NO: 42454 - protein, 586 aa, Homo sapiens; identical to SEQ ID NO: 42451

SEQ ID NO: 42455 - protein, 132 aa, Homo sapiens
  MOD_RES (1)..(1): Any amino acid
XGKLQAISWARTKKIPFLGVCLGMQLAVIEFARNCLNLKDADSTEFRPNAPVPLVIDMPEHNPGNLGGTMRLGIRRTVFKTENSILISLSLGLASVEHTECPSAFDLRDSLFIGLFCELPMLLEMNLDWDLD

SEQ ID NO: 42456 - protein, 1217 aa, Homo sapiens
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCELIDLDLSWLGHLFLFPRWSYLPPARWNSSGEGHLELWDAPVPVFPLTISPGPVTPIPVLYPESASCLLRLRNKLRGVQRNLAGSLVRLSALVKSKQKAYFILSLGRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLIAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISIPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 42457 - protein, 1031 aa, Homo sapiens
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCELIDLDLSWLGHLFLFPRWSYLPPARWNSSGEGHLELWDAPVPVFPLTISPGPVTPIPVLYPESASCLLRLRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLIAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISIPLPHIYLAELLQGGQSPFQATASCHIVSVFSLQLFWVCAYCTSICRQAPGGGWDCRSRGDL

SEQ ID NO: 42458 - protein, 280 aa, Homo sapiens
MQAKYSSTRDMLDDDGDTTMSLHSQGSATTRHPEPRRTEHRAPSSTWRPVALTLLTLCLVLLIGLAALGLLFFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 42459 - protein, 70 aa, Homo sapiens
MQAKYSSTRDMLDDDGDTTMSLHSQGSATTRHPEPRRTEHRAPSSTWRPVALTLLTLCLVLLIGLAALGL

SEQ ID NO: 42460 - protein, 292 aa, Homo sapiens
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAVHSEMLLRVQQLVQDLKKLTCQVATLNNNGEEASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 42461 - protein, 316 aa, Homo sapiens
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAGVSELQEHTTQKAHLGHCPHCPSVCVPVHSEMLLRVQQLVQDLKKLTCQVATLNNNASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 42462 - protein, 292 aa, Homo sapiens; identical to SEQ ID NO: 42460

SEQ ID NO: 42463 - protein, 265 aa, Homo sapiens
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 42464 - protein, 232 aa, Homo sapiens
MSEEVTYADLQFQNSSEMEKIPEIGKFGEKVHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 42465 - protein, 275 aa, Homo sapiens
MWIDFFTYSSMSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 42466 - protein, 87 aa, Homo sapiens
HKCKPCPRRWIWHKDSCYFLSDDVQTWQESKMACAAQNASLLKINNKNIFSVIKKKTEKFFWLGLSWDSSGRSWFWEDGSVPSPSLY

SEQ ID NO: 42467 - protein, 165 aa, Homo sapiens
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQN

SEQ ID NO: 42468 - protein, 213 aa, Homo sapiens
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSA

SEQ ID NO: 42469 - protein, 140 aa, Homo sapiens
MAATGFSAPNGSCHGTSRTVNSDAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 42470 - protein, 906 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGEPAPRPAPQLVHHGGRSRSFSLWSLCELPFLSQKPRRLAAPAS

SEQ ID NO: 42471 - protein, 1053 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 42472 - protein, 1053 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 42473 - protein, 95 aa, Homo sapiens
MHDSNNVEKDITPSELPANPAIRANCHQEPSVCLQAACPESWIGFQRKCFYFSDDTKNWTSSQRFCDSQDADLAQVESFQELVSYPGSRRVCLFE

SEQ ID NO: 42474 - protein, 174 aa, Homo sapiens
MINPELRDGRADGFIHRIVPKLIQNWKIGLMCFLSIIITTVCIIMIATWSKHAKPVACSGDWLGVRDKCFYFSDDTRNWTASKIFCSLQKAELAQIDTQEDMEFLKRYAGTDMHWIGLSRKQGDSWKWTNGTTFNGWFEIIGNGSFAFLSADGVHSSRGFIDIKWICSKPKYFL

SEQ ID NO: 42475 - protein, 149 aa, Homo sapiens
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 42476 - protein, 154 aa, Homo sapiens
MHDSNNVEKDITPSELPANPAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 42477 - protein, 194 aa, Homo sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 42478 - protein, 191 aa, Homo sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 42479 - protein, 132 aa, Homo sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELVSYPGSRRVCLFE

SEQ ID NO: 42480 - protein, 296 aa, Homo sapiens
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQLPAVLEQWRTQQ

SEQ ID NO: 42481 - protein, 237 aa, Homo sapiens
MTSEITYAEVRFKNEFKSSGINTASSAASKERTAPHKSNTGFPKLLCASLLIFFLLLAISFFIAFVIFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 42482 - protein, 165 aa, Homo sapiens
MTSEITYAEVRFKNEFKSSGINTASSAETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 42483 - protein, 204 aa, Homo sapiens
MTSEITYAEVRFKNEFKSSGINTASSAASKERTAPHKSNTGFPKLLCASLLIFFLLLAISFFIAFVKTAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 42484 - protein, 198 aa, Homo sapiens
MTSEITYAEVRFKNEFKSSGINTASSAVFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 42485 - protein, 182 aa, Homo sapiens
MVPEEEPQDRVPHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 42486 - protein, 213 aa, Homo sapiens
MVPEEEPQDREKGLWWFQLKVWSMAVVSILLLSVCFTVSSVVPHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 42487 - protein, 182 aa, Homo sapiens; identical to SEQ ID NO: 42485

SEQ ID NO: 42488 - protein, 213 aa, Homo sapiens; identical to SEQ ID NO: 42486

SEQ ID NO: 42489 - protein, 215 aa, Homo sapiens
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLGLRDENAKGQWRWVDQTPFNPRRVFWHKNEPDNSQGENCVVLVYNQDKWAWNDVPCNFEASRICKIPGTTLN

SEQ ID NO: 42490 - protein, 144 aa, Homo sapiens
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLG

SEQ ID NO: 42491 - protein, 219 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 42492 - protein, 377 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 42493 - protein, 399 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 42494 - protein, 348 aa, Homo sapiens
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 42495 - protein, 324 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQLPAVLEQWRTQQ

SEQ ID NO: 42496 - protein, 256 aa, Homo sapiens
MSDSKEPRVQQLGLLVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQ

SEQ ID NO: 42497 - protein, 332 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 42498 - protein, 387 aa, Homo sapiens
MSDSKEPRVQQLGLLEEDPTTNFQFQQIHGHKSSTGCLGHGALVLQLLSFMLLAGVLPRLSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 42499 - protein, 188 aa, Homo sapiens
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 42500 - protein, 209 aa, Homo sapiens
MMQEQQPQSTEKRGWLSLRLWSVAGISIALLSACFIVSCVVTYHFTYGETGKRLSELHSYHSSLTCFSEGTKVPAWGCCPASWKSFGSSCYFISSEEKVWSKSEQNCVEMGAHLVVFNTEAEQNFIVQQLNESFSYFLGLSDPQGNNNWQWIDKTPYEKNVRFWHLGEPNHSAEQCASIVFWKPTGWGWNDVICETRRNSICEMNKIYL

SEQ ID NO: 42501 - protein, 143 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELISDQNHSYPRKPISKLCMDSRVSHL

SEQ ID NO: 42502 - protein, 247 aa, Homo sapiens
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 42503 - protein, 77 aa, Homo sapiens
MEYHPDLENLDEDGYTQLHFDSQSNTRIAVVSEKGSCAASPPWRLIAVILGILCLVILVIAVVLGTMAGFKAVEFKG

SEQ ID NO: 42504 - protein, 201 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 42505 - protein, 168 aa, Homo sapiens
MEYHPDLENLDEDGYTQLHFDSQSNTRIAVVSEKGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 42506 - protein, 116 aa, Homo sapiens
MEYHPDLENLDEDGYTQLHFDSQSNTRIAVVSEKGSCAASPPWRLIAVILGILCLVILVIAVVLGTMGTGQFLKDLSFLNNRRKLFGDPIQEATHWRMATFYQEIKRTTVNPHNHL

SEQ ID NO: 42507 - protein, 247 aa, Homo sapiens; identical to SEQ ID NO: 42502

SEQ ID NO: 42508 - protein, 189 aa, Homo sapiens
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELISDQNHSYPRKPISKLCMDSRVSHL

SEQ ID NO: 42509 - protein, 3426 aa, Homo sapiens
VLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 42510 - protein, 3388 aa, Homo sapiens
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 42511 - protein, 3565 aa, Homo sapiens
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 42512 - protein, 3564 aa, Homo sapiens
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 42513 - protein, 2109 aa, Homo sapiens
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQGGSGNIGPAFPCLDTPFQARCQGEERTFN

SEQ ID NO: 42514 - protein, 3387 aa, Homo sapiens
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 42515 - protein, 3487 aa, Homo sapiens
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQDLTYSHQISSFLRGFDLSELERTNSTPPVAASYVWDLDPGCEAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 42516 - protein, 225 aa, Homo sapiens
MCDAHLRGPSGIITSPNFPIQYDNNAHCVWIITALNPSKAGGDPGNIQCNKEGLSVETQSLRLRNRSCLLGNSKDNGCCVPNPVHGTGLQVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVCK

SEQ ID NO: 42517 - protein, 426 aa, Homo sapiens
MLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSDHCRYFNQKSGKLDFTPSSTLGQLCKTLHRSLPHLRLQFLHL

SEQ ID NO: 42518 - protein, 1167 aa, Homo sapiens
MVIVILFPAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSGHLAAVCTL

SEQ ID NO: 42519 - protein, 3631 aa, Homo sapiens
MPRSRGRELGRCGCPAGRARGETGISALVPGAGSRWGRPPPPTPPPLLLLLGCGLLSVSAAAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLATQTKLHSIFYKLLFDVLSSPSLTKAGHCGTPEPIVNGHINGENYSYRGSVVYQCNAGFRLIGMSVRICQQDHHWSGKTPFCVPITCGHPGNPVNGLTQGNQFNLNDVVKFVCNPGYMAEGAARSQCLASGQWSDMLPTCRIINCTDPGHQENSVRQVHASGPHRFSFGTTVSYRCNHGFYLLGTPVLSCQGDGTWDRPRPQCLLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 42520 - protein, 426 aa, Homo sapiens; identical to SEQ ID NO: 42517

SEQ ID NO: 42521 - protein, 3707 aa, Homo sapiens
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 42522 - protein, 3667 aa, Homo sapiens
MWSWFLCWKPVQLDRQTASGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 42523 - protein, 3637 aa, Homo sapiens
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 42524 - protein, 3538 aa, Homo sapiens
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 42525 - protein, 836 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 42526 - protein, 343 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 42527 - protein, 170 aa, Homo sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKVSHLLFG

SEQ ID NO: 42528 - protein, 3623 aa, Homo sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 42529 - protein, 105 aa, Homo sapiens
NSKLVDLERKFQGLQQTVDKKVCSSNPCQNGGTCLNLHDSFFCICPPQWKGPLCSADVNECEIYSGTPLSCQNGGTCVNTMGSYRNPCSNIPKEPEEGSRDWHRE

SEQ ID NO: 42530 - protein, 88 aa, Homo sapiens
STGNELAIRFKTDLSINGRGFNASWQAVTGGCGGIFQAPSGEIHSPNYPSPYRSNTDCSWVIRVDRNHRVLLNFTDFDLEPQDSCIMV

SEQ ID NO: 42531 - protein, 464 aa, Homo sapiens
MSHSWNVLWLTFCSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 42532 - protein, 287 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 42533 - protein, 454 aa, Homo sapiens
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 42534 - protein, 465 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 42535 - protein, 415 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 42536 - protein, 299 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSAKGHGYASLAPRAHFLLDALLAFVRERGTGSKAPGYLPSAGLL

SEQ ID NO: 42537 - protein, 260 aa, Homo sapiens
MQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 42538 - protein, 466 aa, Homo sapiens
  MOD_RES (1)..(1): Any amino acid
XVEESAAGEQSSGTQIPRHLEEKDLKPIFEQFGRIFELTVIKDKYTGLHKGCAFLTYCARDSALKAQSALHEQKTLPGMNRPIQVKPADSESRGDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 42539 - protein, 448 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGEDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGFVSFDNPASAQTAIQAMNGFQIGMKRLKVQLKRPKDANRPY

SEQ ID NO: 42540 - protein, 212 aa, Homo sapiens
VSAEGPERAARAEDSARDEPADPGEACGQREPKDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMWPGGRTYDPNLRWQHPSGHHCTSRA

SEQ ID NO: 42541 - protein, 486 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 42542 - protein, 485 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQAMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 42543 - protein, 484 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSHRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQAMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 42544 - protein, 485 aa, Homo sapiens
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGPEGCNLFIYHLPQEFGDTELTQMFLPFGNIISSKVFMDRATNQSKCFGFVSFDNPASAQAAIQAMNGFQIGMKRLKVQLKRPKDPGHPY

SEQ ID NO: 42545 - protein, 320 aa, Homo sapiens
MARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGVWRHGADADVPTLRQYHFLQGVYGSSYQPEQVFRLREL

SEQ ID NO: 42546 - protein, 409 aa, Homo sapiens
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGVVPFPGGHPALETVYANGLVPYPAQSPTVAETLHPAFSGVQQYTAMYPTAAITPIAHSVPQPPPLLQQQQREGVWRHGADADVPTLRQYHFLQGVYGSSYQPEQVFRLREL

SEQ ID NO: 42547 - protein, 481 aa, Homo sapiens
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 42548 - protein, 368 aa, Homo sapiens
MISDPPSNNSWNSVLYLLEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 42549 - protein, 454 aa, Homo sapiens; identical to SEQ ID NO: 42533

SEQ ID NO: 42550 - protein, 342 aa, Homo sapiens
MLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 42551 - protein, 344 aa, Homo sapiens
MNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAANSPPGSGPGTLPGLPAPIGVNGFGPLTPQTNGQPGSDTLYNNGLSPYPAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 42552 - protein, 659 aa, Homo sapiens
MLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 42553 - protein, 759 aa, Homo sapiens
MADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 42554 - protein, 659 aa, Homo sapiens; identical to SEQ ID NO: 42552

SEQ ID NO: 42555 - protein, 659 aa, Homo sapiens; identical to SEQ ID NO: 42552

SEQ ID NO: 42556 - protein, 900 aa, Homo sapiens
MKSVCPVTSGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 42557 - protein, 895 aa, Homo sapiens
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 42558 - protein, 234 aa, Homo sapiens
MIDPDFADKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLIT

SEQ ID NO: 42559 - protein, 913 aa, Homo sapiens
MMSQSSGSGDGNDDEATTSKDGGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 42560 - protein, 780 aa, Homo sapiens
MATSNLLKNKGSLQFEDKWDFMRPIVLKLLRQESVTKQQWFDLFSDVHAVCLWDDKGPAKIHQALKEDILEFIKQAQARVLSHQDDTALLKAYIVEWRKFFTQCDILPKPFCQLEITLMGKQGSNKKSNVEDSIVRKLMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKAYKAVVNDATIFKLELPLKQKGVGLKTQPESKCPELLANYCDMLLRKTPLSKKLTSEEIEAKLKEVLLVLKYVQNKDVFMRYHKAHLTRRLILDISADSEIEENMVEWLREVGMPADYVNKLARMFQDIKVSEDLNQAFKEMHKNNKLALPADSVNIKILNAGAWSRSSEKVFVSLPTELEDLIPEVEEFYKKNHSGRKLHWHHLMSNGIITFKNEVGQYDLEVTTFQLAVLFAWNQRPREKISFENLKLATELPDAELRRTLWSLVAFPKLKRQVLLYEPQVNSPKDFTEGTLFSVNQEFSLIKNAKVQKRGKINLIGRLQLTTERMREEENEGIVQLRILRTQEAIIQIMKMRKKISNAQLQTELVEILKNMFLPQKKMIKEQIEWLIEHKYIRRDESDINTFIYMA

SEQ ID NO: 42561 - protein, 780 aa, Homo sapiens; identical to SEQ ID NO: 42560

SEQ ID NO: 42562 - protein, 1698 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 42563 - protein, 1782 aa, Homo sapiens
MSRGFWLAEPLAGTGPHPAPVAADSRGCSSVPRRHAPSRLSVSTPSRGPGARMVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGEGQCGEEGKAGEGLGRLRDSQDTVAGASDLIRTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 42564 - protein, 144 aa, Homo sapiens
MGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDR

SEQ ID NO: 42565 - protein, 273 aa, Homo sapiens
MKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 42566 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 42567 - protein, 198 aa, Homo sapiens
MHHRNDSQRLGKAGCPPEPSLQMANTNFLSTLSPEHCRPLAGECMNKLKCGAAEAEIMNLPERVGTFSAIPALGGISLPPGVIVMTALHSPAAASAAVTDSAFQIANLADCPQNHSSSSSSSSGGAGGANPAKKKRKRCGVCVPCKRLINCGVCSSCRNRKTGHQICKFRKCEELKKKPGTSLERTPVPSAEAFRWFF

SEQ ID NO: 42568 - protein, 198 aa, Homo sapiens; identical to SEQ ID NO: 42567

SEQ ID NO: 42569 - protein, 322 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 42570 - protein, 69 aa, Homo sapiens [sequence omitted]

SEQ ID NO: 42571 - protein, 80 aa, Homo sapiens
MSSLGGGSQDAGGSSSSSTNGSGGSGSSGPKAGAADKSAVVAAAAPASVADDTPPPERRNKSGIISEPLNKSLRRSRPLS

SEQ ID NO: 42572 - protein, 181 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLP

SEQ ID NO: 42573 - protein, 83 aa, Homo sapiens
MSSLGGGSQDAGGSSSSSTNGSGGSGSSGPKAGAADKSAVVAAAAPASVADDTPPPERRNKSGIISEPLNKSLRRSRPLSHYS

SEQ ID NO: 42574 - protein, 161 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLT

SEQ ID NO: 42575 - protein, 102 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESA

SEQ ID NO: 42576 - protein, 11 aa, Homo sapiens
MSSLGGGSQDA

SEQ ID NO: 42577 - protein, 98 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMG

SEQ ID NO: 42578 - protein, 322 aa, Homo sapiens; identical to SEQ ID NO: 42569

SEQ ID NO: 42579 - protein, 197 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVA

SEQ ID NO: 42580 - protein, 8 aa, Homo sapiens
MSSLGGGS

SEQ ID NO: 42581 - protein, 73 aa, Homo sapiens
MSSLGGGSQDAGGSSSSSTNGSGGSGSSGPKAGAADKSAVVAAAAPASVADDTPPPERRNKSGIISEPLNKSL

SEQ ID NO: 42582 - protein, 137 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHK

SEQ ID NO: 42583 - protein, 690 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 42584 - protein, 759 aa, Homo sapiens
MESRSSPRLECSGAISAHCSLHLPDSSDFQLIFVFLVEMGFHHVGQAGLELLISSDLPTSASQSAGITDMKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 42585 - protein, 690 aa, Homo sapiens; identical to SEQ ID NO: 42583

SEQ ID NO: 42586 - protein, 128 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEK

SEQ ID NO: 42587 - protein, 99 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKD

SEQ ID NO: 42588 - protein, 690 aa, Homo sapiens; identical to SEQ ID NO: 42583

SEQ ID NO: 42589 - protein, 99 aa, Homo sapiens; identical to SEQ ID NO: 42587

SEQ ID NO: 42590 - protein, 690 aa, Homo sapiens; identical to SEQ ID NO: 42583

SEQ ID NO: 42591 - protein, 664 aa, Homo sapiens
MTEKTNGVKSSPANNHNHHAPPAIKANGKDDHRTSSRPHSAADDDTSSELQRLADVDAPQQGRSGFRRIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEVDVQEKLGQLETNMETLYTRFGRLLAEYTGAQQKLKQRITVLETKMKQNNEDDYLSDGMNSPELAAADEP

SEQ ID NO: 42592 - protein, 694 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 42593 - protein, 694 aa, Homo sapiens; identical to SEQ ID NO: 42592

SEQ ID NO: 42594 - protein, 676 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRRKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 42595 - protein, 1251 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 42596 - protein, 299 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTRVMGAGGL

SEQ ID NO: 42597 - protein, 809 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 42598 - protein, 1395 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGKICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRSRLKPLVLQEITSGEKSLIMKPLSIKEKPSTEKESFSQEPSALQKKHTTQEEVSILKEPSSLLKSPTEESPFDEALAFTKKCTIEEAPPTKKPLILKRKHATQGTMSHLKKPLILQTTSGEKSLIKEPLPFKEEKVSLKKKCTTQEMMSICPELLDFQDMIGEDKNSFFMEPMSFRKNPTTEETVLTKTSLSLQEKKITQGKMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 42599 - protein, 291 aa, Homo sapiens
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 42600 - protein, 291 aa, Homo sapiens; identical to SEQ ID NO: 42599

SEQ ID NO: 42601 - protein, 1395 aa, Homo sapiens; identical to SEQ ID NO: 42598

SEQ ID NO: 42602 - protein, 111 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLK

SEQ ID NO: 42603 - protein, 360 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 42604 - protein, 199 aa, Homo sapiens
MPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 42605 - protein, 232 aa, Homo sapiens
MAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 42606 - protein, 1311 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 42607 - protein, 587 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 42608 - protein, 357 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDRTSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPPLILLQGWACRQPATHLLPSPLEDSLLCPRPFPHPACLQLGGWGGQPG

SEQ ID NO: 42609 - protein, 359 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDRTSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAGKASLKHTW

SEQ ID NO: 42610 - protein, 580 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPPPPKIPKIETTHPPLPPAHPPPDRKPPLAAALGEAEPPGPVDATDLPKVQIPPPAHPAPVHQPPPLPHRPPPPPPSSYMTGMSTTSSYMSGEGYQSLQSMMKTEGPSYGALPPAYGPPAHLPYHPHVYPPNPPPPPVPPPPASFPPPAIPPPTPGYPPPPPTYNPNFPPPPPRLPPTHAVPPHPPPGLGLPPASYPPPAVPPGGQPPVPPPIPPPGMPPVGGLGRAAWMR

SEQ ID NO: 42611 - protein, 600 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVSGLKQALGRAGFPGGGNTTVVSPKEENKAAEPPPPKIPKIETTHPPLPPAHPPPDRKPPLAAALGEAEPPGPVDATDLPKVQIPPPAHPAPVHQPPPLPHRPPPPPPSSYMTGMSTTSSYMSGEGYQSLQSMMKTEGPSYGALPPAYGPPAHLPYHPHVYPPNPPPPPVPPPPASFPPPAIPPPTPGYPPPPPTYNPNFPPPPPRLPPTHAVPPHPPPGLGLPPASYPPPAVPPGGQPPVPPPIPPPGMPPVGGLGRAAWMR

SEQ ID NO: 42612 - protein, 110 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETP

SEQ ID NO: 42613 - protein, 227 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTS

SEQ ID NO: 42614 - protein, 172 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSDQLHLPKPG

SEQ ID NO: 42615 - protein, 526 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 42616 - protein, 520 aa, Homo sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 42617 - protein, 226 aa, Homo sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEGK

SEQ ID NO: 42618 - protein, 347 aa, Homo sapiens [sequence omitted]

SEQ ID NO: 42619 - protein, 951 aa, Homo sapiens
MAAAAAAAAAVGVRLRDCCSRGAVLLLFFSLSPRPPAAAAWLLGLRPEDTAGGRVSLEGGTLRAAEGTSFLLRVYFQPGPPATAAPVPSPTLNSGENGTGDWAPRLVFIEEPPGGGGVAPSAVPTRPPGPQRCREQSDWASDVEVLGPLRPGGVAGSALVQVRVRELRKGEAERGGAGGGGKLFSLCAWDGRAWHHHGAAGGFLLRVRPRLYGPGGDLLPPAWLRALGALLLLALSALFSGLRLSLLSLDPVELRVLRNSGSAAEQEQARRVQAVRGRGTHLLCTLLLGQAGANAALAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 42620 - protein, 830 aa, Homo sapiens
MAAAAAAAAAVGVRLRDCCSRGAVLLLFFSLSPRPPAAAAWLLGLRPEDTAGGRVSLEGGTLRAAEGTSFLLRVYFQPGPPRCREQSDWASDVEVLGPLRPGGVAGSALVQLFSLCAWDGRAWHHHGAAGGFLLRVRPRLYGPGGDLLPPAWLRALGALLLLALSALFSGLRLSLLSLDPVELRVLRNSGSAAEQEQARRVQAVRGRGTHLLCTLLLGQAGANAALAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPSSDSECCNINLDTETSPCSSDFEENVGKKLLRTLSGQKRKRSPEGERTSEDNSNLTPLIT

SEQ ID NO: 42621 - protein, 607 aa, Homo sapiens
MAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLPVSVSRTFAVSRGDSLAGSPVNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 42622 - protein, 880 aa, Homo sapiens
MAAAAAAAAAVGVRLRDCCSRGAVLLLFFSLSPRPPAAAAWLLGLRPEDTAGGRVSLEGGTLRAAEGTSFLLRVYFQPGPPRCREQSDWASDVEVLGPLRPGGVAGSALVQLFSLCAWDGRAWHHHGAAGGFLLRVRPRLYGPGGDLLPPAWLRALGALLLLALSALFSGLRLSLLSLDPVELRVLRNSGSAAEQEQARRVQAVRGRGTHLLCTLLLGQAGANAALAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 42623 - protein, 404 aa, Homo sapiens
MGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 42624 - protein, 853 aa, Homo sapiens
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 42625 - protein, 552 aa, Homo sapiens
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKEHTNKKPKSYQH

SEQ ID NO: 42626 - protein, 875 aa, Homo sapiens
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPVPLSLSRTFVVSRTELLAAGSPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 42627 - protein, 854 aa, Homo sapiens [sequence omitted]

SEQ ID NO: 42628 - protein, 876 aa, Homo sapiens [sequence omitted]

SEQ ID NO: 42629 - protein, 574 aa, Homo sapiens
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKEHTNKKPKSYQHCNEQNCVTHSKANHSLHNEGAI

SEQ ID NO: 42630 - protein, 707 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 42631 - protein, 659 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 42632 - protein, 680 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPSLPLLPRGRDSAAYSDSDLFGLSHLVSAVTAFVWP

SEQ ID NO: 42633 - protein, 775 aa, Homo sapiens
MAPVGGGGRPVGGPARGRLLLAAPVLLVLLWALGARGQGSPQQGTIVGMRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 42634 - protein, 263 aa, Homo sapiens
MYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKPQSWPCFSRPGDRVCLPAPPSMNSSLPHADHSAAVPERAAGFSHGEQPSVSHRRVHHPHGELGREV

SEQ ID NO: 42635 - protein, 730 aa, Homo sapiens
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGSSSSSSSSVKQYISSHNSVFNHPLPPPPPVTYQVGYGHLSTLVKLDKKPVETNGPDANHEYSTSSQHMDYKDTFDMLDSLLSAQGMNM

SEQ ID NO: 42636 - protein, 663 aa, Homo sapiens
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGGLRTSQHPRETGQEASGDQRS

SEQ ID NO: 42637 - protein, 488 aa, Homo sapiens
MATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGGLRTSQHPRETGQEASGDQRS

SEQ ID NO: 42638 - protein, 287 aa, Homo sapiens
MEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 42639 - protein, 316 aa, Homo sapiens
MGNTTSCCVSSSPKLRRNAHSRLESYRPDTDLSREDTGCNLQHISDRENIDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 42640 - protein, 341 aa, Homo sapiens
MGNTTSCCVSSSPKLRRNAHSRLESYRPDTDLSREDTGCNLQHISDRENIDDLNMEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 42641 - protein, 287 aa, Homo sapiens; identical to SEQ ID NO: 42638

SEQ ID NO: 42642 - protein, 208 aa, Homo sapiens
MDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 42643 - protein, 341 aa, Homo sapiens; identical to SEQ ID NO: 42640

SEQ ID NO: 42644 - protein, 313 aa, Homo sapiens
MEPMYQDRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 42645 - protein, 360 aa, Homo sapiens
MAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 42646 - protein, 272 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 42647 - protein, 167 aa, Homo sapiens
MGKTEEKGNGKGAFQERKGPLGAVRKEAGAGAQDAGAAEGAAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42648 - protein, 746 aa, Homo sapiens
MSQSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42649 - protein, 779 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42650 - protein, 770 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42651 - protein, 746 aa, Homo sapiens; identical to SEQ ID NO: 42648

SEQ ID NO: 42652 - protein, 783 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPAPAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42653 - protein, 232 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRESVCTSPNDERGLQRQSESQPLESQPASAAAGAVRVGRRPEASKRRENGRKGPAVRLTGHQRQREEDQLGRVLVSGIRLRF

SEQ ID NO: 42654 - protein, 746 aa, Homo sapiens; identical to SEQ ID NO: 42648

SEQ ID NO: 42655 - protein, 37 aa, Homo sapiens
MGDEKDSWKVKTLDEILQEKKRRKEQEEKAEIKRLKN

SEQ ID NO: 42656 - protein, 780 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 42657 - protein, 151 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRR

SEQ ID NO: 42658 - protein, 420 aa, Homo sapiens
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPAPAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGLPERRGVPVPEQDRGGHLWSGLQSKRQENR

SEQ ID NO: 42659 - protein, 212 aa, Homo sapiens
MEAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 42660 - protein, 227 aa, Homo sapiens
MNGTIYANECQQIRHPNSKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 42661 - protein, 118 aa, Homo sapiens
MEAKTLGTVTPRKPVLSVSARKIKDNAADWHNLILKWETLNDAGFTTANNIANLKISLLNKDKIELDSSSPASKENEEKVCLEYNEELEKLCEELQATLDGLMRFRISSWRCTGRSCS

SEQ ID NO: 42662 - protein, 212 aa, Homo sapiens; identical to SEQ ID NO: 42659

SEQ ID NO: 42663 - protein, 305 aa, Homo sapiens
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 42664 - protein, 305 aa, Homo sapiens; identical to SEQ ID NO: 42663

SEQ ID NO: 42665 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 42666 - protein, 260 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 42667 - protein, 367 aa, Homo sapiens
MGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 42668 - protein, 592 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEGGDGHCEGKNLKRNRFFFW

SEQ ID NO: 42669 - protein, 455 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVR

SEQ ID NO: 42670 - protein, 363 aa, Homo sapiens
MPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEFIPLSLLSACCPIFTNICSQLTIRYVFISGMKTDQYSELVPVEWGIAEKIPKNVEATLELGNRQRFEQFGELRRRQENVGKFGTF

SEQ ID NO: 42671 - protein, 590 aa, Homo sapiens
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQENTGNAQTERKKNLPDVE

SEQ ID NO: 42672 - protein, 455 aa, Homo sapiens; identical to SEQ ID NO: 42669

SEQ ID NO: 42673 - protein, 291 aa, Homo sapiens
MPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEVRLYQRHEDRPIQ

SEQ ID NO: 42674 - protein, 1030 aa, Homo sapiens
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 42675 - protein, 1030 aa, Homo sapiens; identical to SEQ ID NO: 42674

SEQ ID NO: 42676 - protein, 651 aa, Homo sapiens
MSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLPEAPWIHKLL

SEQ ID NO: 42677 - protein, 657 aa, Homo sapiens
MSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLIQRRQRLGVRRCQLLM

SEQ ID NO: 42678 - protein, 361 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 42679 - protein, 405 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 42680 - protein, 373 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 42681 - protein, 551 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 42682 - protein, 551 aa, Homo sapiens; identical to SEQ ID NO: 42681

SEQ ID NO: 42683 - protein, 551 aa, Homo sapiens; identical to SEQ ID NO: 42681

SEQ ID NO: 42684 - protein, 551 aa, Homo sapiens; identical to SEQ ID NO: 42681

SEQ ID NO: 42685 - protein, 565 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPADHSTGKSSQRQMVFGVVTAIDLLNFVAAQERDQK

SEQ ID NO: 42686 - protein, 177 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEK

SEQ ID NO: 42687 - protein, 508 aa, Homo sapiens
MPSETPQAEVGPTGCPHRSGPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 42688 - protein, 463 aa, Homo sapiens [sequence omitted]

SEQ ID NO: 42689 - protein, 103 aa, Homo sapiens
MMAEPWQALQLLLAILLTLMALPYQARKKTFLSVHEVMAVENYAKDSLQWITDQYNKESDDKYHFRIFRVLKVQRQQVNCFFSVFAVPWFEQYKILNKSCSSD

SEQ ID NO: 42690 - protein, 138 aa, Homo sapiens
MMAEPWQALQLLLAILLTLMALPYQARKKTFLSVHEVMAVENYAKDSLQWITDQYNKESDDKYHFRIFRVLKVQRQVTDHLEYHLNVEMQWTTCQKPETTNCVPQERELHKQVNCFFSVFAVPWFEQYKILNKSCSSD

SEQ ID NO: 42691 - protein, 98 aa, Homo sapiens
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 42692 - protein, 98 aa, Homo sapiens
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 42693 - protein, 146 aa, Homo sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 42694 - protein, 146 aa, Homo sapiens; identical to SEQ ID NO: 42693

SEQ ID NO: 42695 - protein, 146 aa, Homo sapiens; identical to SEQ ID NO: 42693

SEQ ID NO: 42696 - protein, 142 aa, Homo sapiens
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 42697 - protein, 141 aa, Homo sapiens
MARPLCTLLLLMATLAGALASSSKEENRIIPGGIYDADLNDEWVQRALHFAISEYNKATEDEYYRRPLQVLRAREQTFGGVNYFFDVEVGRTICTKSQPNLDTCAFHEQPELQKKQLCSFEIYEVPWEDRMSLVNSRCQEA

SEQ ID NO: 42698 - protein, 141 aa, Homo sapiens
MAWPLCTLLLLLATQAVALAWSPQEEDRIIEGGIYDADLNDERVQRALHFVISEYNKATEDEYYRRLLRVLRAREQIVGGVNYFFDIEVGRTICTKSQPNLDTCAFHEQPELQKKQLCSFQIYEVPWEDRMSLVNSRCQEA

SEQ ID NO: 42699 - protein, 141 aa, Homo sapiens
MAQYLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 42700 - protein, 141 aa, Homo sapiens; identical to SEQ ID NO: 42699

SEQ ID NO: 42701 - protein, 193 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 42702 - protein, 193 aa, Homo sapiens; identical to SEQ ID NO: 42701

SEQ ID NO: 42703 - protein, 193 aa, Homo sapiens; identical to SEQ ID NO: 42701

SEQ ID NO: 42704 - protein, 193 aa, Homo sapiens; identical to SEQ ID NO: 42701

SEQ ID NO: 42705 - protein, 170 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 42706 - protein, 193 aa, Homo sapiens
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 42707 - protein, 193 aa, Homo sapiens; identical to SEQ ID NO: 42706

SEQ ID NO: 42708 - protein, 194 aa, Homo sapiens
MPNWGGGAKCGACEKTVYHAEEIQCNGRSFHKTCFHCMACRKALDSTTVAAHESEIYCKVCYGRRYGPKGIGYGQGAGCLSTDTGEHLGLQFQQSPKPARSVTTSNPSKFTAKFGESEKCPRCGKSVYAAEKVMGGGKPWHKTCFRCAICGKSLESTNVTDKDGELYCKVCYAKNFGPTGIGFGGLTQQVEKKE

SEQ ID NO: 42709 - protein, 194 aa, Homo sapiens; identical to SEQ ID NO: 42708

SEQ ID NO: 42710 - protein, 454 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 42711 - protein, 167 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEYNACTVKFTNLKCTAG

SEQ ID NO: 42712 - protein, 262 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKI

SEQ ID NO: 42713 - protein, 420 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 42714 - protein, 422 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 42715 - protein, 372 aa, Homo sapiens
MAKQLQARRLDGIDYNPWVEFVKLASEHDVVNLGQGFPDFPPPDFAVEAFQHAVSGDFMLNQYTKTFVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 42716 - protein, 159 aa, Homo sapiens
AMAKQLQARRLDGIDYNPWVEFVKLASEHDVVNLGQGFPDFPPPDFAVEAFQHAVSGDFMLNQYTKTFVSLCYPGWSAMVRSWSTAALTLPVSSGPPTSASGVTGTTGWSQSWLESSFFDPKKKKIIWGYPPLTKILASFFGELLGQEIDPLRNVLVTV

SEQ ID NO: 42717 - protein, 184 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPN

SEQ ID NO: 42718 - protein, 159 aa, Homo sapiens; identical to SEQ ID NO: 42716

SEQ ID NO: 42719 - protein, 516 aa, Homo sapiens
MFRTAAAISVHLVGPLQGRKAGAPLTWFLHQTQVAEKNVGSPAPRPTSHLGLANPQERKVPQGPQSPCEVPAAEGILRTGGAKLPIQGHPAKLAMAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 42720 - protein, 251 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSA

SEQ ID NO: 42721 - protein, 200 aa, Homo sapiens
MEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 42722 - protein, 1036 aa, Homo sapiens
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 42723 - protein, 165 aa, Homo sapiens
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 42724 - protein, 77 aa, Homo sapiens
MPKCPKCNKEVYFAERVTSLGKDWHRPCLKCEKCGKTLTSGGHAEHEGKPYCNHPCYAAMFGPKGFGRGGAESHTFK

SEQ ID NO: 42725 - protein, 77 aa, Homo sapiens; identical to SEQ ID NO: 42724

SEQ ID NO: 42726 - protein, 77 aa, Homo sapiens; identical to SEQ ID NO: 42724

SEQ ID NO: 42727 - protein, 208 aa, Homo sapiens
MASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 42728 - protein, 282 aa, Homo sapiens
MPPHHLLPWLAQVPSAEGELVRLVSRAGGRGACFWPAVTMEMAVAAGCVCKGGGCCHREPSQDHHESQEHRGPLVGSQTCLVHQAEGTAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 42729 - protein, 104 aa, Homo sapiens
  MOD_RES (1)..(1): Any amino acid
XPGGERAEGAGRPGAPTMASKCPKCDKTVYFAEKVTSLGKDWHRPCLRCERCGKTLTPGGHAEHDGQPYCHKPCYGILFGPKGVNTGAVGSYIYDRDPEGKVQP

SEQ ID NO: 42730 - protein, 178 aa, Homo sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHD

SEQ ID NO: 42731 - protein, 249 aa, Homo sapiens
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 42732 - protein, 249 aa, Homo sapiens; identical to SEQ ID NO: 42731

SEQ ID NO: 42733 - protein, 249 aa, Homo sapiens; identical to SEQ ID NO: 42731

SEQ ID NO: 42734 - protein, 178 aa, Homo sapiens; identical to SEQ ID NO: 42730

SEQ ID NO: 42735 - protein, 178 aa, Homo sapiens; identical to SEQ ID NO: 42730

SEQ ID NO: 42736 - protein, 278 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAMKTYLNKREGINVWKCFLRLRHFQLLRGEQLLTFSGNNMNRKNTPYQQGTPCAGCPDDCDKGLCTNSCQYQDLLSNCDSLKNTAGCEHELLKEKCKATCLCENKIY

SEQ ID NO: 42737 - protein, 243 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 42738 - protein, 497 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 42739 - protein, 422 aa, Homo sapiens
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPGAFPILTDLTPETTRRWKLGSHPHSTYVKMKMQRDEATFPGLYGKQVAKLGSQSRQSDRGTRLIHSQQASSQR

SEQ ID NO: 42740 - protein, 420 aa, Homo sapiens
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 42741 - protein, 420 aa, Homo sapiens; identical to SEQ ID NO: 42740

SEQ ID NO: 42742 - protein, 420 aa, Homo sapiens; identical to SEQ ID NO: 42740

SEQ ID NO: 42743 - protein, 379 aa, Homo sapiens
MSSRIARALALVVTLLHLTRLALSTCPAACHCPLEAPKCAPGVGLVRDGCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVTGQCCEEWVCDEDSIKDPMEDQDGLLGKELGFDASEVELTRNNELIAVGKGSSLKRLPVFGMEPRILYNPLQGQKCIVQTTSWSQCSKTCGTGISTRVTNDNPECRLVKETRICEVRPCGQPVYSSLKKGKKCSKTKKSPEPVRFTYAGCLSVKKYRPKYCGSCVDGRCCTPQLTRCEDAVPLRRWGDIFQERHDDPVKCNYNCPHANEAAFPFYRLFNDIHKFRD

SEQ ID NO: 42744 - protein, 381 aa, Homo sapiens [sequence omitted]

SEQ ID NO: 42745 - protein, 357 aa, Homo sapiens
MSSRIARALALVVTLLHLTRLALSTCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVTGQCCEEWVCDEDSIKDPMEDQDGLLGKELGFDASEVELTRNNELIAVGKGSSLKRLPVFGMEPRILYNPLQGQKCIVQTTSWSQCSKTCGTGISTRVTNDNPECRLVKETRICEVRPCGQPVYSSLKKGKKCSKTKKSPEPVRFTYAGCLSVKKYRPKYCGSCVDGRCCTPQLTRTVKMRFRCEDGETFSKNVMMIQSCKCNYNCPHANEAAFPFYRLFNDIHKFRD

SEQ ID NO: 42746 - protein, 337 aa, Homo sapiens
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 42747 - protein, 346 aa, Homo sapiens
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 42748 - protein, 726 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 42749 - protein, 831 aa, Homo sapiens
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 42750 - protein, 748 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 42751 - protein, 738 aa, Homo sapiens
MQTPPLQQPHQEQVFLAFLVIVIPSFLTKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 42752 - protein, 739 aa, Homo sapiens
MEPTSGPFRTDLGYHLVGCSSGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 42753 - protein, 564 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 42754 - protein, 182 aa, Homo sapiens
MVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKKPGSA

SEQ ID NO: 42755 - protein, 146 aa, Homo sapiens [sequence omitted]

SEQ ID NO: 42756 - protein, 228 aa, Homo sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 42757 - protein, 179 aa, Homo sapiens
MLSRCRSGLLHVLGLSFLLQTRRPILLCSPRLMKPLVVFVLGGPGAGKGTQCARIVEEMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 42758 - protein, 409 aa, Homo sapiens
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQK

SEQ ID NO: 42759 - protein, 449 aa, Homo sapiens
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQKVEMSYQRMENPGCHVVDASPSREKVLQTVLSLIQNSFSEP

SEQ ID NO: 42760 - protein, 366 aa, Homo sapiens
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRSQLGGTLYHPSLHLLGSEVCGTGILDSSHSSQGLE

SEQ ID NO: 42761 - protein, 434 aa, Homo sapiens
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 42762 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 42763 - protein, 570 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 42764 - protein, 303 aa, Homo sapiens [sequence omitted]

SEQ ID NO: 42765 - protein, 538 aa, Homo sapiens
MGNWAVNEGLSIFVISALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 42766 - protein, 237 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGPWSAEGATLLSNSAQFH

SEQ ID NO: 42767 - protein, 276 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGWKYSSGFVTADMIKEHLPPPAKSTLILVCGPPPLIQTAAHPNLEKLGYTQDMIFTY

SEQ ID NO: 42768 - protein, 116 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIF

SEQ ID NO: 42769 - protein, 237 aa, Homo sapiens; identical to SEQ ID NO: 42766

SEQ ID NO: 42770 - protein, 146 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTL

SEQ ID NO: 42771 - protein, 171 aa, Homo sapiens
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITK

SEQ ID NO: 42772 - protein, 276 aa, Homo sapiens; identical to SEQ ID NO: 42767

SEQ ID NO: 42773 - protein, 301 aa, Homo sapiens
MGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 42774 - protein, 334 aa, Homo sapiens
MNRSLLVGCMQSKDIWGREESICERLKQDGLDVERAESWELGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 42775 - protein, 278 aa, Homo sapiens
MKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 42776 - protein, 278 aa, Homo sapiens; identical to SEQ ID NO: 42775

SEQ ID NO: 42777 - protein, 278 aa, Homo sapiens; identical to SEQ ID NO: 42775

SEQ ID NO: 42778 - protein, 278 aa, Homo sapiens; identical to SEQ ID NO: 42775

SEQ ID NO: 42779 - protein, 147 aa, Homo sapiens
MKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIR

SEQ ID NO: 42780 - protein, 109 aa, Homo sapiens
MDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKGKLWHL

SEQ ID NO: 42781 - protein, 521 aa, Homo sapiens
MLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKDYREEEKKVLNGMLPKSQVTDTLAKEGPSYPSYDWFQTDSLVTIAIYTKQKDINLDSIIVDHQNDSFRAETIIKDCLYLIHIGLSHEVQEDFSVRVVESVGKIEIVLQKKENTSWDFLGHPLKNHNSLIPRKDTGLYYRKCQLISKEDVTHDTRLFCLMLPPSTHLQVPIGQHVYLKLPITGTEIVKPYTPVSGSLLSEFKEPVLPNNKYIYFLIKIYPTGLFTPELDRLQIGDFVSVSSPEGNFKISKFQELEDLFLLAAGTGFTPMVKILNYALTDIPSLRKVKLMFFNKTEDDIIWRSQLEKLAFKDKRLDVEFVLSAPISEWNGKQGHISPALLSEFLKRNLDKSKVLVCICGPVPFTEQGVRLLHDLNFSKNEIHSFTA

SEQ ID NO: 42782 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPKP

SEQ ID NO: 42783 - protein, 134 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 42784 - protein, 124 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPETLITTIDSSSSWWTNWVIPAISAVAVALMYRLYMAED

SEQ ID NO: 42785 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 42786 - protein, 150 aa, Homo sapiens
MSGSMATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 42787 - protein, 146 aa, Homo sapiens
MATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 42788 - protein, 251 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 42789 - protein, 251 aa, Homo sapiens; identical to SEQ ID NO: 42788

SEQ ID NO: 42790 - protein, 251 aa, Homo sapiens; identical to SEQ ID NO: 42788

SEQ ID NO: 42791 - protein, 138 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQGQV

SEQ ID NO: 42792 - protein, 318 aa, Homo sapiens
MKQKTKPGTGPLSSLEFGVSFLAPSPHMELLASCPRSRLSPWGGWAPPPSHSRDLRPLPQDDGVCLSMEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 42793 - protein, 222 aa, Homo sapiens
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 42794 - protein, 222 aa, Homo sapiens; identical to SEQ ID NO: 42793

SEQ ID NO: 42795 - protein, 222 aa, Homo sapiens; identical to SEQ ID NO: 42793

SEQ ID NO: 42796 - protein, 222 aa, Homo sapiens; identical to SEQ ID NO: 42793

SEQ ID NO: 42797 - protein, 231 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQASKLHRVYVLESWHL

SEQ ID NO: 42798 - protein, 169 aa, Homo sapiens
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 42799 - protein, 171 aa, Homo sapiens
MLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 42800 - protein, 129 aa, Homo sapiens
MASRLLRGAGTLAAQALRARGPSGAAAMRSMASGGGVPTDEEQATGLEREIMLAAKKGLDPYNVLAPKGASGTREDPNLVPSISNKRIVGCICEEDNTSVVWFWLHKGEAQRCPRCGAHYKLVPQQLAH

SEQ ID NO: 42801 - protein, 109 aa, Homo sapiens
MAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 42802 - protein, 86 aa, Homo sapiens
MAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 42803 - protein, 103 aa, Homo sapiens
MHPHPQIPGRDLAGFSTMAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 42804 - protein, 75 aa, Homo sapiens
MAPEVLPKPRMRGLLARRLRNHMAVAFVLSLGVAALYKFRVADQRKKAYADFYRNYDVMKDFEEMRKAGIFQSVK

SEQ ID NO: 42805 - protein, 75 aa, Homo sapiens; identical to SEQ ID NO: 42804

SEQ ID NO: 42806 - protein, 75 aa, Homo sapiens; identical to SEQ ID NO: 42804

SEQ ID NO: 42807 - protein, 75 aa, Homo sapiens; identical to SEQ ID NO: 42804

SEQ ID NO: 42808 - protein, 75 aa, Homo sapiens; identical to SEQ ID NO: 42804

SEQ ID NO: 42809 - protein, 75 aa, Homo sapiens; identical to SEQ ID NO: 42804

SEQ ID NO: 42810 - protein, 75 aa, Homo sapiens; identical to SEQ ID NO: 42804

SEQ ID NO: 42811 - protein, 75 aa, Homo sapiens; identical to SEQ ID NO: 42804

SEQ ID NO: 42812 - protein, 75 aa, Homo sapiens; identical to SEQ ID NO: 42804

SEQ ID NO: 42813 - protein, 75 aa, Homo sapiens; identical to SEQ ID NO: 42804

SEQ ID NO: 42814 - protein, 79 aa, Homo sapiens
MQALRVSQALIRSFSSTARNRFQNRVREKQKLFQEDNDIPLYLKGGIVDNILYRVTMTLCLGGTVYSLYSLGWASFPRN

SEQ ID NO: 42815 - protein, 109 aa, Homo sapiens
  MOD_RES (1)..(1): Any amino acid
XSFWVLSLPGPSRQPGHPQARLQGESPPNPAGSSRVSQALIRSFSSTARNRFQNRVREKQKLFQEDNDIPLYLKGGIVDNILYRVTMTLCLGGTVYSLYSLGWASFPRN

SEQ ID NO: 42816 - protein, 83 aa, Homo sapiens
MLRNLLALRQIGQRTISTASRRHFKNKVPEKQKLFQEDDEIPLYLKGGVADALLYRATMILTVGGTAYAIYELAVASFPKKQE

SEQ ID NO: 42817 - protein, 115 aa, Homo sapiens
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGTAYAIYELAVASFPKKQE

SEQ ID NO: 42818 - protein, 115 aa, Homo sapiens; identical to SEQ ID NO: 42817

SEQ ID NO: 42819 - protein, 114 aa, Homo sapiens
MYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 42820 - protein, 114 aa, Homo sapiens; identical to SEQ ID NO: 42819

SEQ ID NO: 42821 - protein, 81 aa, Homo sapiens
MMFPLARNALSSLKIQSILQSMARHSHVKHSPDFHDKYGNAVLASGTAFCVATWVFTATQIGIEWNLSPVGRVTPKEWKHQ

SEQ ID NO: 42822 - protein, 81 aa, Homo sapiens; identical to SEQ ID NO: 42821

SEQ ID NO: 42823 - protein, 81 aa, Homo sapiens; identical to SEQ ID NO: 42821

SEQ ID NO: 42824 - protein, 32 aa, Homo sapiens
MMFPLARNALSSLKIQSILQSMARHSHVKHSP

SEQ ID NO: 42825 - protein, 80 aa, Homo sapiens
MFPLARNALSSLKIQSILQSMARHSHVKHSPDFHDKYGNAVLASGTAFCVATWVFTATQIGIEWNLSPVGRVTPKEWKHQ

SEQ ID NO: 42826 - protein, 63 aa, Homo sapiens
MLGQSIRRFTTSVVRRSHYEEGPGKNLPFSVENKWSLLAKMCLYFGSAFATPFLVVRHQLLKT

SEQ ID NO: 42827 - protein, 63 aa, Homo sapiens; identical to SEQ ID NO: 42826

SEQ ID NO: 42828 - protein, 325 aa, Homo sapiens
MAAAAASLRGVVLGPRGAGLPGARARGLLCSARPGQLPLRTPQAVALSSKSGLSRGRKVMLSALGMLAAGGAGLAMALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 42829 - protein, 83 aa, Homo sapiens
MEPFVVLVLCLSFMLLFSLWRQSCRRRKLPPGPTPLPIIGNMLQIDVKDICKSFTNVSLPYVPPANCKGSQKSMVLCSPCILA

SEQ ID NO: 42830 - protein, 72 aa, Homo sapiens
MEPFVVLVLCLSFMLLFSLWRQSCRRRKLPPGPTPLPIIGNMLQIDVKDICKSFTNVSLPYVPPANCKGVLL

SEQ ID NO: 42831 - protein, 140 aa, Homo sapiens
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRICATTSTIKMQTHSVTMWLPPAVLQSQHGVCLFL

SEQ ID NO: 42832 - protein, 520 aa, Homo sapiens
MPQLSLSSLGLWPMAASPWLLLLLVGASWLLARILAWTYTFYDNCCRLRCFPQPPKRNWFLGHLGLVTPTEQGMRVLTQLVATYPQGFKVWMGPIFPVIRFCHPNIIRSVINASAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 42833 - protein, 484 aa, Homo sapiens
MLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 42834 - protein, 512 aa, Homo sapiens [sequence omitted]

SEQ ID NO: 42835 - protein, 512 aa, Homo sapiens [sequence omitted]

SEQ ID NO: 42836 - protein, 483 aa, Homo sapiens
MLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNNNFGEVVGSGNPADFIPILRYLPNPSLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHRKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 42837 - protein, 516 aa, Homo sapiens
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 42838 - protein, 503 aa, Homo sapiens
MALRAKAEVCMAVPWLSLQRAQALGTRAARVPRTVLPFEAMPRRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVASSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 42839 - protein, 437 aa, Homo sapiens
MALRAKAEVCMAVPWLSLQRAQALGTRAARVPRTVLPFEAMPRRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVASSDLVLQNYHIPAGVLKHLQVETLTQEDIKMVYSFILRPSMFPLLTFRAIN

SEQ ID NO: 42840 - protein, 503 aa, Homo sapiens
MALRAKAEVCVAAPWLSLQRARALGTRAARAPRTVLPFEAMPQHPGNRWLRLLQIWREQGYEHLHLEMHQTFQELGPIFRYNLGGPRMVCVMLPEDVEKLQQVDSLHPCRMILEPWVAYRQHRGHKCGVFLLNGPEWRFNRLRLNPDVLSPKAVQRFLPMVDAVARDFSQALKKKVLQNARGSLTLDVQPSIFHYTIEASNLALFGERLGLVGHSPSSASLNFLHALEVMFKSTVQLMFMPRSLSRWISPKVWKEHFEAWDCIFQYGDNCIQKIYQELAFNRPQHYTGIVAELLLKAELSLEAIKANSMELTAGSVDTTAFPLLMTLFELARNPDVQQILRQESLAAAASISEHPQKATTELPLLRAALKETLRLYPVGLFLERVVSSDLVLQNYHIPAGTLVQVFLYSLGRNAALFPRPERYNPQRWLDIRGSGRNFHHVPFGFGMRQCLGRRLAEAEMLLLLHHVLKHFLVETLTQEDIKMVYSFILRPGTSPLLTFRAIN

SEQ ID NO: 42841 - protein, 508 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 42842 - protein, 503 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 42843 - protein, 503 aa, Homo sapiens; identical to SEQ ID NO: 42842

SEQ ID NO: 42844 - protein, 503 aa, Homo sapiens; identical to SEQ ID NO: 42842

SEQ ID NO: 42845 - protein, 166 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAE

SEQ ID NO: 42846 - protein, 218 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDGTEIFTLTS

SEQ ID NO: 42847 - protein, 359 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKKHDAK

SEQ ID NO: 42848 - protein, 352 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQK

SEQ ID NO: 42849 - protein, 242 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYK

SEQ ID NO: 42850 - protein, 181 aa, Homo sapiens [sequence omitted]

SEQ ID NO: 42851 - protein, 218 aa, Homo sapiens; identical to SEQ ID NO: 42846

SEQ ID NO: 42852 - protein, 352 aa, Homo sapiens; identical to SEQ ID NO: 42848

SEQ ID NO: 42853 - protein, 283 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELI

SEQ ID NO: 42854 - protein, 165 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCA

SEQ ID NO: 42855 - protein, 503 aa, Homo sapiens; identical to SEQ ID NO: 42842

SEQ ID NO: 42856 - protein, 172 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHL

SEQ ID NO: 42857 - protein, 244 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKESAIVVKIQGYFDAWQALLIKPDIFFKISWLYKKYEKSVKDLKDAIEVLIAEKRRRISTEEKLEECMDFATELILAEKRGDLTRENVNQCILEM

SEQ ID NO: 42858 - protein, 494 aa, Homo sapiens
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 42859 - protein, 494 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 42860 - protein, 443 aa, Homo sapiens
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 42861 - protein, 494 aa, Homo sapiens
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 42862 - protein, 491 aa, Homo sapiens
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 42863 - protein, 291 aa, Homo sapiens
MRCMLTNSHPWCGCDWQFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 42864 - protein, 490 aa, Homo sapiens [sequence omitted]

SEQ ID NO: 42865 - protein, 490 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 42866 - protein, 457 aa, Homo sapiens
MERSFLEEAIPQYLKELLKDLVGAHISVSALVTGVRGMENRALKSFSAELSLSAWLPSVAALSSLAVNSPSFCPFFLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 42867 - protein, 388 aa, Homo sapiens
MFLQPIAKGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 42868 - protein, 307 aa, Homo sapiens
MAAKCCSTFFLGCEFSQFLPLFLLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 42869 - protein, 490 aa, Homo sapiens [sequence omitted]

SEQ ID NO: 42870 - protein, 453 aa, Homo sapiens
MDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMLVLKMIRTERTKRKRVGKLFWVSVRVT

SEQ ID NO: 42871 - protein, 446 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 42872 - protein, 497 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 42873 - protein, 497 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRGQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 42874 - protein, 443 aa, Homo sapiens
QEALTLPLQLRRRFGDVFSLQLAWTPVVVLNGLAAVREALVTHGEDTADRPPVPITQILGFGPRGQGVFLARYGPAWREQRRFSVSTLRNLGLGKKSLEQWVTEEAACLCAAFANHDAPFAPTVSWTKPNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 42875 - protein, 446 aa, Homo sapiens [sequence omitted]

SEQ ID NO: 42876 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 42877 - protein, 493 aa, Homo sapiens; identical to SEQ ID NO: 42876

SEQ ID NO: 42878 - protein, 86 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAV

SEQ ID NO: 42879 - protein, 491 aa, Homo sapiens
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 42880 - protein, 502 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 42881 - protein, 501 aa, Homo sapiens
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 42882 - protein, 564 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPASTVGMDRVNVSRVYTAGSHIYTPAVVFRSLSHGPHAHLTHAAKMHNRTPIHNYKGHKATAGLAFHRHKYSPSAITST

SEQ ID NO: 42883 - protein, 504 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 42884 - protein, 229 aa, Homo sapiens
MAMEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 42885 - protein, 544 aa, Homo sapiens
MSSPGPSQPPAEDPPWPARLLRAPLGLLRLDPSGGALLLCGLVALLGWSWLRRRRARGIPPGPTPWPLVGNFGHVLLPPFLRRRSWLSSRTRAAGIDPSVIGPQVLLAHLARVYGSIFSFFIGHYLVVVLSDFHSVREALVQQAEVFSDRPRVPLISIVTKEKGVVFAHYGPVWRQQRKFSHSTLRHFGLGKLSLEPKIIEEFKYVKAEMQKHGEDPFCPFSIISNAVSNIICSLCFGQRFDYTNSEFKKMLGFMSRGLEICLNSQVLLVNICPWLYYLPFGPFKELRQIEKDITSFLKKIIKDHQESLDRENPQDFIDMYLLHMEEERKNNSNSSFDEEYLFYIIGDLFIAGTDTTTNSLLWCLLYMSLNPDVQEKVHEEIERVIGANRAPSLTDKAQMPYTEATIMEVQRLTVVVPLAIPHMTSENTVLQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 42886 - protein, 501 aa, Homo sapiens
MSSPGPSQPPAEDPPWPARLLRAPLVGNFGHVLLPPFLRRRSWLSSRTRAAGIDPSVIGPQVLLAHLARVYGSIFSFFIGHYLVVVLSDFHSVREALVQQAEVFSDRPRVPLISIVTKEKGVVFAHYGPVWRQQRKFSHSTLRHFGLGKLSLEPKIIEEFKYVKAEMQKHGEDPFCPFSIISNAVSNIICSLCFGQRFDYTNSEFKKMLGFMSRGLEICLNSQVLLVNICPWLYYLPFGPFKELRQIEKDITSFLKKIIKDHQESLDRENPQDFIDMYLLHMEEERKNNSNSSFDEEYLFYIIGDLFIAGTDTTTNSLLWCLLYMSLNPDVQEKVHEEIERVIGANRAPSLTDKAQMPYTEATIMEVQRLTVVVPLAIPHMTSENTVLQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 42887 - protein, 465 aa, Homo sapiens
MLLLGLLLLLPLLAGARLLWNWWKLRSLHLPPLAPGFLHLLQPDLPIYLLGLTQKFGPIYRLHLGLQDKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 42888 - protein, 495 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 42889 - protein, 495 aa, Homo sapiens; identical to SEQ ID NO: 42888

SEQ ID NO: 42890 - protein, 465 aa, Homo sapiens; identical to SEQ ID NO: 42887

SEQ ID NO: 42891 - protein, 465 aa, Homo sapiens; identical to SEQ ID NO: 42887

SEQ ID NO: 42892 - protein, 494 aa, Homo sapiens [sequence omitted]

SEQ ID NO: 42893 - protein, 494 aa, Homo sapiens [sequence omitted]

SEQ ID NO: 42894 - protein, 495 aa, Homo sapiens; identical to SEQ ID NO: 42888

SEQ ID NO: 42895 - protein, 464 aa, Homo sapiens
MLLLGLLLLPLLAGARLLWNWWKLRSLHLPPLAPGFLHLLQPDLPIYLLGLTQKFGPIYRLHLGLQDKLVSKNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQNQ

SEQ ID NO: 42896 - protein, 465 aa, Homo sapiens; identical to SEQ ID NO: 42887

SEQ ID NO: 42897 - protein, 464 aa, Homo sapiens; identical to SEQ ID NO: 42895

SEQ ID NO: 42898 - protein, 495 aa, Homo sapiens
MLLLGLLLLLPLLAGARLLWNWWKLRSLHLLPLAPGFLHLLQPDLPIYLLGLTQKFGPIYRLHLGLQDVVVLNSKRTIEEAMVKKWADFAGRPEPLTYKLVSKNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQNQ

SEQ ID NO: 42899 - protein, 495 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSKNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQNQ

SEQ ID NO: 42900 - protein, 465 aa, Homo sapiens
MLLLGLLLLLPLLAGARLLWNWWKLRSLHLLPLAPGFLHLLQPDLPIYLLGLTQKFGPIYRLHLGLQDKLVSKNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQNQ

SEQ ID NO: 42901 - protein, 514 aa, Homo sapiens
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 42902 - protein, 448 aa, Homo sapiens
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGIVRKYDIQATDNEPVEMLHSGTLVPSRELPIAFCQR

SEQ ID NO: 42903 - protein, 497 aa, Homo sapiens
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 42904 - protein, 428 aa, Homo sapiens
MKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 42905 - protein, 428 aa, Homo sapiens; identical to SEQ ID NO: 42904

SEQ ID NO: 42906 - protein, 522 aa, Homo sapiens
MFPWGLSCLSVLGAAGTALLCAGLLLSLAQHLWTLRWMLSRDRASTLPLPKGSMGWPFFGETLHWLVQGSRFHSSRRERYGTVFKTHLLGRPVIRVSGAENVRTILLGEHRLVRSQWPQSAHILLGSHTLLGAVGEPHRRRRKVLARVFSRAALERYVPRLQGALRHEVRSWCAAGGPVSVYDASKALTFRMAARILLGLRLDEAQCATLARTFEQLVENLFSLPLDVPFSGLRKGIRARDQLHRHLEGAISEKLHEDKAAEPGDALDLIIHSARELGHEPSMQELKESAVELLFAAFFTTASASTSLVLLLLQHPAAIAKIREELVAQGLGRACGCAPGAAGGSEGPPPDCGCEPDLSLAALGRLRYVDCVVKEVLRLLPPVSGGYRTALRTFELDGYQIPKGWSVMYSIRDTHETAAVYRSPPEGFDPERFGAAREDSRGASSRFHYIPFGGGARSCLGQELAQAVLQLLAVELVRTARWELATPAFPAMQTVPIVHPVDGLRLFFHPLTPSVAGNGLCL

SEQ ID NO: 42907 - protein, 531 aa, Homo sapiens
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 42908 - protein, 508 aa, Homo sapiens
MTQTLKYASRVFHRVRWAPELGASLGYREYHSARRSLADIPGPSTPSFLAELFCKGGLSRLHELQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 42909 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 42910 - protein, 353 aa, Homo sapiens
MALIPDLAMETWLLLAVSLVLLYLVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 42911 - protein, 79 aa, Homo sapiens
MVPIIAQYGDVLVRNLRREAETGKPVTLKDVFGAYSMDVITSTSFGVNIDSLNNPQDPFVENTKKLLRFDFLDPFFLSI

SEQ ID NO: 42912 - protein, 504 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPESRFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 42913 - protein, 420 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERSH

SEQ ID NO: 42914 - protein, 280 aa, Homo sapiens
MNLETGNGPHHFPMWRYVGEKPEAGSREQQVHQLERFLWGLHHGCNHWHIIWSELGFSQQSTRSLSEKYEEAFKIGFFGSLFTLNIQSLAVLPRPECMVRSGLTETSTSWVRVILLPQPPEELGLQHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERSH

SEQ ID NO: 42915 - protein, 503 aa, Homo sapiens
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 42916 - protein, 126 aa, Homo sapiens
MDLIPNFAMETWVLVATSLVLLYIYGTHSHKLFKKLGIPGPTPLPFLGTILFYLRGLWNFDRECNEKFLWGLHHGCNHWHIIWSELGFSQQSTRSLSEKYEEAFKIGFFGSLFTLNITLSISYPSF

SEQ ID NO: 42917 - protein, 74 aa, Homo sapiens
MDLIPNFAMETWVLVATSLVLLYIYGTHSHKLFKKLGIPGPTPLPFLGTILFYLRGLWNFDRECNEKYGEMWGP

SEQ ID NO: 42918 - protein, 502 aa, Homo sapiens
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 42919 - protein, 39 aa, Homo sapiens
MDLIPNLAVETWLLLAVSLVLLYLMRVPKSAKSPLTKQT

SEQ ID NO: 42920 - protein, 492 aa, Homo sapiens
MQLLMLELLLLFIVYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 42921 - protein, 533 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWREPEKFLPERFSKKNKDNIDPYIYTPFGSGPRNCIGMRFALVNMKLALVRVLQNFSFKPCKETQIPLKLRFGGLLLTEKPIVLKAESRDETFVDMEPIHMDFLRSLAFQGPHLCFFWELLCPTIR

SEQ ID NO: 42922 - protein, 503 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWREPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 42923 - protein, 469 aa, Homo sapiens
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMTLLQATLDIVETETSKENSPNYGLLLLWASLSNAVPVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 42924 - protein, 519 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 42925 - protein, 520 aa, Homo sapiens [sequence omitted]

SEQ ID NO: 42926 - protein, 455 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSR

SEQ ID NO: 42927 - protein, 157 aa, Homo sapiens
MKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRPSDPTEEGSTTEGGGAGEDQEEEAFGFSGYPPLGQNGEWEHLVRQGPPC

SEQ ID NO: 42928 - protein, 524 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 42929 - protein, 454 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGLRPLPFRPREHQGEVTSGFYSLLGRAQKLHRAGVRHG

SEQ ID NO: 42930 - protein, 524 aa, Homo sapiens; identical to SEQ ID NO: 42928

SEQ ID NO: 42931 - protein, 524 aa, Homo sapiens
MSLLSLPWLGLRPVATSPWLLLLLVVGSWLLARILAWTYAFYNNCRRLQCFPQPPKRNWFWGHLGLITPTEEGLKNSTQMSATYSQGFTIWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSCLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVSLQ

SEQ ID NO: 42932 - protein, 524 aa, Homo sapiens; identical to SEQ ID NO: 42931

SEQ ID NO: 42933 - protein, 531 aa, Homo sapiens
MLPITDRLLHLLGLEKTAFRIYAVSTLLLFLLFFLFRLLLRFLRLCRSFYITCRRLRCFPQPPRRNWLLGHLGMYLPNEAGLQDEKKVLDNMHHVLLVWMGPVLPLLVLVHPDYIKPLLGASAAIAPKDDLFYGFLKPWLGDGLLLSKGDKWSRHRRLLTPAFHFDILKPYMKIFNQSADIMHAKWRHLAEGSAVSLDMFEHISLMTLDSLQKCVFSYNSNCQEKMSDYISAIIELSALSVRRQYRLHHYLDFIYYRSADGRRFRQACDMVHHFTTEVIQERRRALRQQGAEAWLKAKQGKTLDFIDVLLLARDEDGKELSDEDIRAEADTFMFEGHDTTSSGISWMLFNLAKYPEYQEKCREEIQEVMKGRELEELEWDDLTQLPFTTMCIKESLRQYPPVTLVSRQCTEDIKLPDGRIIPKGIICLVSIYGTHHNPTVWPDSKVYNPYRFDPDNPQQRSPLAYVPFSAGPRNCIGQSFAMAELRVVVALTLLRFRLSVDRTRKVRRKPELILRTENGLWLKVEPLPPRA

SEQ ID NO: 42934 - protein, 520 aa, Homo sapiens
MPQLSLSSLGLWPMAASPWLLLLLVGASWLLARILAWTYTFYDNCCRLRCFPQPPKRNWFLGHLGLIHSSEEGLLYTQSLACTFGDMCCWWVGPWHAIVRIFHPTYIKPVLFAPAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 42935 - protein, 447 aa, Homo sapiens
MRVLTQLVATYPQGFKVWMGPIFPVIRFCHPNIIRSVINASAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 42936 - protein, 332 aa, Homo sapiens
MPSITTAAASGVSRSPGNRTGSWVTWAWKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 42937 - protein, 519 aa, Homo sapiens
MSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLTPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 42938 - protein, 267 aa, Homo sapiens
TPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGL

SEQ ID NO: 42939 - protein, 503 aa, Homo sapiens
MAGLWLGLVWQKLLLWGAASALSLAGASLVLSLLQRVASYALLMKPDGREFFQQIIEYTEEYRHMPLLKLWVGPVPMVALYNAENVEVILTSSKQIDKSSMYKFLEPWLGLGLLTSTGNKWRSRRKMLTPTFHFTILEDFLDIMNEQANILVKKLEKHINQEAFNCFFYITLCALDIICETAMGKNIGAQSNDDSEYVRAVYRMSEMIFRRIKMPWLWLDLWYLMFKEGWEHKKSLQILHTFTNSVIAERANEMNANEDCRGDGRGSAPSKNKRRAFLDLLLSVTDDEGNRLSHEDIREEVDTFMFEGHDTTAAAINWSLYLLGSNPEVQKKVDHELDDVFGKSDRPATVEDLKKLRYLECVIKETLRLFPSVPLFARSVSEDCEVAGYRVLKGTEAVIIPYALHRDPRYFPNPEEFQPERFFPENAQGRHPYAYVPFSAGPRNCIGQKFAVMEEKTILSCILRHFWIESNQKREELGLEGQLILRPSNGIWIKLKRRNADER

SEQ ID NO: 42940 - protein, 525 aa, Homo sapiens
MAGLWLGLVWQKLLLWGAASALSLAGASLVLSLLQRVASYARKWQQMRPIPTVARAYPLVGHALLMKPDGREFFQQIIEYTEEYRHMPLLKLWVGPVPMVALYNAENVEVILTSSKQIDKSSMYKFLEPWLGLGLLTSTGNKWRSRRKMLTPTFHFTILEDFLDIMNEQANILVKKLEKHINQEAFNCFFYITLCALDIICETAMGKNIGAQSNDDSEYVRAVYRMSEMIFRRIKMPWLWLDLWYLMFKEGWEHKKSLQILHTFTNSVIAERANEMNANEDCRGDGRGSAPSKNKRRAFLDLLLSVTDDEGNRLSHEDIREEVDTFMFEGHDTTAAAINWSLYLLGSNPEVQKKVDHELDDVFGKSDRPATVEDLKKLRYLECVIKETLRLFPSVPLFARSVSEDCEVAGYRVLKGTEAVIIPYALHRDPRYFPNPEEFQPERFFPENAQGRHPYAYVPFSAGPRNCIGQKFAVMEEKTILSCILRHFWIESNQKREELGLEGQLILRPSNGIWIKLKRRNADER

SEQ ID NO: 42941 - protein, 500 aa, Homo sapiens
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 42942 - protein, 403 aa, Homo sapiens
MSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 42943 - protein, 509 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 42944 - protein, 404 aa, Homo sapiens
MVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 42945 - protein, 449 aa, Homo sapiens
MKHEKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 42946 - protein, 504 aa, Homo sapiens
MMTTSLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPMDGNTTENINDTFIKTLQGHALNSLTESMMENLQRIMRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDENGKTKTTFYCNGLKLKYYYMPFGSGATICPGRLFAIHEIKQFLILMLSYFELELIEGQAKCPPLDQSRAGLGILPPLNDIEFKYKFKHL

SEQ ID NO: 42947 - protein, 506 aa, Homo sapiens
MAGEVSAATGRFSLERLGLPGLALAAALLLLALCLLVRRTRRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 42948 - protein, 501 aa, Homo sapiens
MVLWGPVLGALLVVIAGYLCLPGMLRQRRPWEPPLDKGTVPWLGHAMAFRKNMFEFLKRMRTKHGDVFTVQLGGQYFTFVMDPLSFGSILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEVKLFILLMVTHFDLELVDPDTPLPHVDPQRWGFGTMQPSHDVRFRYRLHPTE

SEQ ID NO: 42949 - protein, 190 aa, Homo sapiens
MEKVPGEMEIERRERSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 42950 - protein, 397 aa, Homo sapiens
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 42951 - protein, 398 aa, Homo sapiens
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 42952 - protein, 218 aa, Homo sapiens
MMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLAGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKFQVSPGEP

SEQ ID NO: 42953 - protein, 398 aa, Homo sapiens; identical to SEQ ID NO: 42951

SEQ ID NO: 42954 - protein, 339 aa, Homo sapiens
MQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 42955 - protein, 339 aa, Homo sapiens; identical to SEQ ID NO: 42954

SEQ ID NO: 42956 - protein, 359 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 42957 - protein, 253 aa, Homo sapiens
MFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 42958 - protein, 400 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLAGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 42959 - protein, 399 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 42960 - protein, 399 aa, Homo sapiens
MDEDGGGEGGGVPEDLSLEEREELLDIRRRKKELIDDIERLKYEIAEVMTEIDNLTSVEESKTTQRNKQIAMGRKKFNMDPKKGIQFLIENDLLQSSPEDVAQFLYKGEGLNKTVIGDYLGERDEFNIKVLQAFVELHEFADLNLVQALRQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 42961 - protein, 314 aa, Homo sapiens
MALPQLQTAMLAAFLWDPRDVVLTAQPGAEQCAESSQHIRILQPQFRLIRLRFWKLYIQRRVQAWQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 42962 - protein, 394 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRNLFDSIKSEPFSIPEDDGNDLTHTFFNPDREGWLLKLGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 42963 - protein, 157 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRFREGASDLGFGG

SEQ ID NO: 42964 - protein, 291 aa, Homo sapiens
DRSTGHLFPRGVGMDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRVTWECSQRRSRERTFQKEEVARTEACPDWERRGVQCGREPLRQHQE

SEQ ID NO: 42965 - protein, 147 aa, Homo sapiens
  MOD_RES (1)..(1): Any amino acid
XTHTSGSLSSRDSQAGDSASRAGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 42966 - protein, 117 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGE

SEQ ID NO: 42967 - protein, 258 aa, Homo sapiens
MVLCVQGPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 42968 - protein, 275 aa, Homo sapiens
MYLEHTSHCPHHDDDTAMDTPLPRPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 42969 - protein, 422 aa, Homo sapiens
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 42970 - protein, 233 aa, Homo sapiens
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQTQSRSVTQAGVQWCDLCLLQPSPPRFKRFSCLSLPSSWDYRHPPPRLANFCIISRDGVSPCWPGWSRTCDLR

SEQ ID NO: 42971 - protein, 256 aa, Homo sapiens
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWR

SEQ ID NO: 42972 - protein, 255 aa, Homo sapiens
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLW

SEQ ID NO: 42973 - protein, 136 aa, Homo sapiens
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 42974 - protein, 1253 aa, Homo sapiens
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 42975 - protein, 1255 aa, Homo sapiens
MGPKHVLRQPGPSERHHPEVPAWTPRAGPPCWLCRQRWGWTLHPPGRGCPALLLSEPRMAAQVTLEDALSNVDLLEELPLPDQQPCIEPPPSSLLYQNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 42976 - protein, 822 aa, Homo sapiens
MAESLGSAELLRQLKSLGMERLLHAVNTFLRQSCTYLPLLTFGGKTSFVSLDVYGTEANCSATSCSFPKAAATWPRRQAPGPLGELVRGPPDQGVAEQSFSHGLFEFGITNVPCIFSPPQMFPWIIQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 42977 - protein, 1253 aa, Homo sapiens; identical to SEQ ID NO: 42974

SEQ ID NO: 42978 - protein, 161 aa, Homo sapiens
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITL

SEQ ID NO: 42979 - protein, 151 aa, Homo sapiens
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKD

SEQ ID NO: 42980 - protein, 1278 aa, Homo sapiens
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPRVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 42981 - protein, 1253 aa, Homo sapiens
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPKVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 42982 - protein, 1253 aa, Homo sapiens; identical to SEQ ID NO: 42981

SEQ ID NO: 42983 - protein, 952 aa, Homo sapiens
EKRRRWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 42984 - protein, 216 aa, Homo sapiens
MAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTASFHPRTTTRQTCQRPALLPLWIQASQHCLQPHLQLLQEFRGATSFQDYADSWVIRASLWSWRNC

SEQ ID NO: 42985 - protein, 1178 aa, Homo sapiens
MTTHVTLEDALSNVDLLEELPLPNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 42986 - protein, 1538 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42987 - protein, 1478 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLDGTTTKAEGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42988 - protein, 1471 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKLVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42989 - protein, 704 aa, Homo sapiens
  MOD_RES (1)..(1): Any amino acid
XTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKIADSEAECEDKEGNLFPSEVSCTVSFQYVFGDSCGFYNNS

SEQ ID NO: 42990 - protein, 1494 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALVRGTSTGKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKIADSEAECEDKEGNLFPSEVSCTRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42991 - protein, 1477 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLESRHMREDMEYIGLDSGRIRTRRQSSGSATNVASTPDNRGRSRAKVVSQSQPGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42992 - protein, 1255 aa, Homo sapiens
MLQNCSDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKIADSEAECEDKEGNLFPSEVSCTRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42993 - protein, 1245 aa, Homo sapiens
MTTGKDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLDGTTTKAEGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 42994 - protein, 995 aa, Homo sapiens
MGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 42995 - protein, 431 aa, Homo sapiens
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLECEAFWRSGRTAKLYSV

SEQ ID NO: 42996 - protein, 1505 aa, Homo sapiens
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 42997 - protein, 1513 aa, Homo sapiens
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 42998 - protein, 1514 aa, Homo sapiens
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGAGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 42999 - protein, 1293 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 43000 - protein, 1063 aa, Homo sapiens
MRRLICKRICDYKSFDDEESVDGNRPSSAASAFKVPAPKTSGNPANSARKPGSAGGPKVGELLSIMIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDDLFSDNGRVRAKLSAPLAGMGNAKADSRGRSRTKMVSQSQRSSSPDKNEGSQSANTIGAGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALVLFDFKTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERV

SEQ ID NO: 43001 - protein, 559 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43002 - protein, 576 aa, Homo sapiens
MPPPSPDSENGFYPGLPSSMNPAFFPSFSPVSPHGCTGLSVPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43003 - protein, 567 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43004 - protein, 562 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRMDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43005 - protein, 1007 aa, Homo sapiens
MRDFGFGVLQTAPLRSSSPGPLFCGEAYGPYAVGSVNPLPSATPFGPLSPPPLPVTGFLEAASPFSVPLGGGAGSPAAAASSSSPFLAHQQTMQDELLLGLTQQPARPLSGAAATEKLPDHHPGGGTIAGVTHLLPSQDFKPSLHHPSSSSASSCCCCRTSSPQDFSKRQQQQLSSQKRKEFSPPHLPHPPDSKPPPPPPPLHCPGRFSPPPPPAGPLLQPAQLAQRQQQQPPQQFSLLHQQHLSPQDFAPRQRPADLPPLPQLPPSPPAAPRRRHGGAGSPRKTPAAGEGSAAESPNAGLASSTPVNPAPGSMESPNHPLLNSPSNLLPGGALGAGAFSSLQSPDLPHPGGGGGGGGGGPPGGGGGGGSASPPPLPGFGTPWSVQTASPPPQPQQPPPTQPQQQPPPPQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRMDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43006 - protein, 589 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43007 - protein, 1034 aa, Homo sapiens
MRDFGFGVLQTAPLRSSSPGPLFCGEAYGPYAVGSVNPLPSATPFGPLSPPPLPVTGFLEAASPFSVPLGGGAGSPAAAASSSSPFLAHQQTMQDELLLGLTQQPARPLSGAAATEKLPDHHPGGGTIAGVTHLLPSQDFKPSLHHPSSSSASSCCCCRTSSPQDFSKRQQQQLSSQKRKEFSPPHLPHPPDSKPPPPPPPLHCPGRFSPPPPPAGPLLQPAQLAQRQQQQPPQQFSLLHQQHLSPQDFAPRQRPADLPPLPQLPPSPPAAPRRRHGGAGSPRKTPAAGEGSAAESPNAGLASSTPVNPAPGSMESPNHPLLNSPSNLLPGGALGAGAFSSLQSPDLPHPGGGGGGGGGGPPGGGGGGGSASPPPLPGFGTPWSVQTASPPPQPQQPPPTQPQQQPPPPQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43008 - protein, 1026 aa, Homo sapiens
MRDFGFGVLQTAPLRSSSPGPLFCGEAYGPYAVGSVNPLPSATPFGPLSPPPLPVTGFLEAASPFSVPLGGGAGSPAAAASSSSPFLAHQQTMQDELLLGLTQQPARPLSGAAATEKLPDHHPGGGTIAGVTHLLPSQDFKPSLHHPSSSSASSCCCCRTSSPQDFSKRQQQQLSSQKRKEFSPPHLPHPPDSKPPPPPPPLHCPGRFSPPPPPAGPLLQPAQLAQRQQQQPPQQFSLLHQQHLSPQDFAPRQRPADLPPLPQLPPSPPAAPRRRHGGAGSPRKTPAAGEGSAAESPNAGLASSTPVNPAPGSMESPNHPLLNSPSNLLPGGALGAGAFSSLQSPDLPHPGGGGGGGGGGPPGGGGGGGSASPPPLPGFGTPWSVQTASPPPQPQQPPPTQPQQQPPPPQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 43009 - protein, 698 aa, Homo sapiens
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGKHYPPSGPPMSFADIMWRNHFAGRMGINFHHPGTDNIMALNNAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 43010 - protein, 684 aa, Homo sapiens
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGRMGINFHHPGTDNIMALNSRSSLFPFEDAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 43011 - protein, 684 aa, Homo sapiens; identical to SEQ ID NO: 43010

SEQ ID NO: 43012 - protein, 729 aa, Homo sapiens
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKGRLNYSYPGSDSSLLINARTYGRRRGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 43013 - protein, 712 aa, Homo sapiens
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKARTYGRRRGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 43014 - protein, 682 aa, Homo sapiens
MSTPAVPQDLQLPPSQRAQSAFKEQRRQKLKEHLLRRKTLFAYKQENEMLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 43015 - protein, 494 aa, Homo sapiens
MSTPAVPQDLQLPPSQRAQSAFKEQRRQKLKEHLLRRKTLFAYKQENEMLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQVR

SEQ ID NO: 43016 - protein, 683 aa, Homo sapiens
MSTPAVPQDLQLPPSQRAQSAFKEQRRQKLKEHLLRRKTLFAYKQENEMLSSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 43017 - protein, 495 aa, Homo sapiens
MSTPAVPQDLQLPPSQRAQSAFKEQRRQKLKEHLLRRKTLFAYKQENEMLSSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQHI

SEQ ID NO: 43018 - protein, 1972 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVNPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 43019 - protein, 1972 aa, Homo sapiens; identical to SEQ ID NO: 43018

SEQ ID NO: 43020 - protein, 301 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKPKTFMTKLRQKNGKREKRPWSL

SEQ ID NO: 43021 - protein, 2039 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVNPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKSCMCLPQILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 43022 - protein, 151 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKA

SEQ ID NO: 43023 - protein, 2032 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVNPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 43024 - protein, 339 aa, Homo sapiens
MKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 43025 - protein, 393 aa, Homo sapiens
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 43026 - protein, 194 aa, Homo sapiens
MWVKLLSIVAEFCFSPFLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 43027 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 43028 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 43029 - protein, 137 aa, Homo sapiens
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 43030 - protein, 56 aa, Homo sapiens
MACLGFQRHKAQLNLATRTWPCTLLFFLLFIPVFCKVPPTEPECEKQFQPYFIPIN

SEQ ID NO: 43031 - protein, 325 aa, Homo sapiens
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 43032 - protein, 521 aa, Homo sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 43033 - protein, 319 aa, Homo sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLVTCVPPACGPGSPRPARLPHPALRTPGVCPQPLRL

SEQ ID NO: 43034 - protein, 387 aa, Homo sapiens
MVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 43035 - protein, 325 aa, Homo sapiens
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLVTCVPPACGPGSPRPARLPHPALRTPGLRQESLASSCHAHV

SEQ ID NO: 43036 - protein, 141 aa, Homo sapiens
MLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 43037 - protein, 202 aa, Homo sapiens
MSFPPLWPTRHVPASHPTCPLLPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRVGATPGLGHSLSWVRAPPGLGHSLSGVGATPGLGHLLSGVGASPGEDTEHAAALTPCGVPPVPGCRSHSQPLSHLVSSSRCCGP

SEQ ID NO: 43038 - protein, 282 aa, Homo sapiens
MALSCSSWCRSPQWKFEASKSHANHRPICLSPRIWPGSASATSTVCSSSESFLPRGPPAVSLLLHGPPTVSFPPPWPTHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRVGATPGLGHSLSWVRAPPGLGHSLSGVGATPGLGHLLSGVGASPGEDTEHAAALTPCGVPPVPGCRSHSQPLSHLVSSSRCCGP

SEQ ID NO: 43039 - protein, 414 aa, Homo sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 43040 - protein, 357 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 43041 - protein, 332 aa, Homo sapiens
MEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 43042 - protein, 380 aa, Homo sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 43043 - protein, 203 aa, Homo sapiens
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDSESF

SEQ ID NO: 43044 - protein, 414 aa, Homo sapiens; identical to SEQ ID NO: 43039

SEQ ID NO: 43045 - protein, 388 aa, Homo sapiens
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 43046 - protein, 391 aa, Homo sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 43047 - protein, 377 aa, Homo sapiens
SSIIQNRLKKLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 43048 - protein, 357 aa, Homo sapiens; identical to SEQ ID NO: 43040

SEQ ID NO: 43049 - protein, 378 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 43050 - protein, 1369 aa, Homo sapiens
MSPCGRKMGEGRQQRRAPVGKLLLLPGRRDTPHGRSGSSGARTQRSLLWLLVHVWLWAASGSSAQLFNLTLSVDEGLPPDTLVGDIRAGLPAAQQQEGSGFFLSEDSDDSPLLDDFHVHPDTGIIRTARRLDRERRDHYSFVAATLLGAVVQVEIRVNDVNDHSPRFPLDSLQLDVSELSPPGTAFRLPVAHDPDAGLFSTQGYTLVQPSDLPKDPAGPFFQLRYRTPGPLPSPLLPGSSSPLEPLDLVLLRRLDREEAAAHRLQIEAWDGGRPRRTGLLSVELRVLDENDNPPVFEQDEYRAAVREDAQPGAEVCRVRATDRDLGPNGFVRYSVRARQVPGAGSGGGALGDAAYFAVEELSGVVRVWRPLDREAQAWHQLVVEARDGGAEPEVATVRVSIAVLDVNDNRPAIHVLFLTEGGVARVSEGARPGDYVARVSVSDADGDWEKEDEATGELGVGLGDGSISLSLEGGEGDFALLPGGPPGVFFLCVEGPLDRESRDLYELLLVATDAGSPPLSTEETLLLRVADLNDQPPLFSQQHYKASVSEAAAPGTVVMWVSASDADEAGSDHAWLRYTVVQLSAPCNLGSLQSKMVHTAECGPSFAIDSESGAISTIRTLDREVQEAVELKVVAQDLGEPPLSATCLVSITVDDVNDNEPIFWRQVYNATIAEHAPVGHCFLQVTASDADSGLYGFIEYSLYDGFLSYEAPQAFRIDPHDGQICVSQDIDRERDPATYDLLVEAKDGGGLSAQAFVRVDLEDVNDNHPVFNPSTYVTSISDETQPGTEIINVLATDQDSGIYGTVAYELIPGNVSSLFTIDSTTGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGELINWVALDREHRGHHEMTVLVTDRGSPPRNATMAVYVSVTDINDNRPFFPQCLPGKELHVKVLEGQPVNMLVTTVFAKDPDEGNNAEVTYSVSSARPMPLKGKTAFGKQSCKKQTNKQTNKILT

SEQ ID NO: 43051 - protein, 2916 aa, Homo sapiens
MRLDEITKSENEDGEKKMFTQQFESTDACVYEVYVKINSIVKSQSQCGLKRGSPETELWGAIVFRSQEENAKPVKETEVTASDADSGLYGFIEYSLYDGFLSYEAPQAFRIDPHDGQICVSQDIDRERDPATYDLLVEAKDGDEQRMTHLALVKGGLSAQAFVRVDLEDVNDNHPVFNPSTYVTSISDETQPGTEIINVLATDQDSGIYGTVAYELIPGNVSSLFTIDSTTGLYSPEVEILSAVNFSADKEVMNSLEMFLPLLRHFKKVERDEEAAEKKFEASRGWFMRFKGRRHLHYLKVQDEAASADGEAAARYVANLAKILGEGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGPAGTIYVITWADGAAAFSGTDFAFSSDELQAFVLKSLFCELGEGELINWVALDREHRGHHEMTVLVTDRGSPPRNATMAVYVSVTDINDNRPFFPQCLPGKELHVKVLEGQPVNMLVTTVFAKDPDEGNNAEVTYSVSSEDSSDHFKIDANNGEIRTTTILSYDYRPSYRMSVIATDQGVPPLQGQAVVNIQVIPLSKGRAIMSQNIRHLIIPENLKPTKIMSLIKSSDHLQQHYNGKLHFSIVADDKDGHFEIDSSTGDLFLSKELDYETTSHYLFRVITTDHSKNLSLSSTVFLSIDVEDQNDHSPSFQDELIVISVEENVPIGTLVYVFNAKDDDGSFLNSRIQYYIESHNPGTNPFLIHPSFGTLVTVSRLDRESIPTVILTVTASDQAVNVTDRRLRSLTAQIVILDVNDHNPTFISFPNAHVKEDVTVGSLVHHITAHDPDEGRNGKVTYSILSGNENMTFMLDESSGLLTTTCPLDYEMKTQHILTVLALDDGTPALSSSQTLTVTVLDVNDEAPVFKQHLYEASVKENQNPGEFVTRVEALDRDSGVNSKLQFEIMPGASFELFEINSDTGEVVTTTILDREIQEVFTLRVLVRDGGFPSLSSTTTILCTVEDENDHAPEFIVSSYDIEVLENQEPEVVYTVLASDMDAGNNRAVEYHIIDGNTDECFTINEMSGELSTTRALDREQISNFTLVILCSDLGDPPRSSVIHLQVRVLDANDHSPSFPTLYYQSSVREDAEVGTVVLVLSAVDKDEGLNGQTEYFLTDEASGAFTIDPMSGTLKTSNTLDREARSQHTFSAVARDCSIQGSRSTTVIIKVYVTDVNDNDPVLEQNPFDVFLSPESPTNQTTVIVRADDLDLGPNGTVVFSFAETQSMFSIDKYTGEIQFQQNPSSEYFPIWLQLKVTDQGIPARTTTGLLVIHMEGEDVKISFSHHLYKGLVTENCEAGTSIVTVKAFAPDSIQDSMKYSIFSGNEDGVLSLCSKSGQLTVKEPKFLDFEVRNEVQLIVLAESSGHRAYCKVAVLIQDENDNSPCFEQSIYQASVSESQLYNAHVIQVFATDLDSGLNGLIEYSILSGNQEEAFQIDALSGVITTKAILDYELTSSYSLIVQATDKGMPRLSNTTVIKVQVTDINDNAPAFLPSEAVEITEDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNKTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRHSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 43052 - protein, 709 aa, Homo sapiens
MSPCGRKMGEGRQQRRAPVGKLLLLPGRRDTPHGRSGSSGARTQRSLLWLLVHVWLWAASGSSAQLFNLTLSVDEGLPPDTLVGDIRAGLPAAQQQEGSGFFLSEDSDDSPLLDDFHVHPDTGIIRTARRLDRERRDHYSFVAATLLGAVVQVEIRVNDVNDHSPRFPLDSLQLDVSELSPPGTAFRLPVAHDPDAGLFSTQGYTLVQPSDLPKDPAGPFFQLRYRTPGPLPSPLLPGSSSPLEPLDLVLLRRLDREEAAAHRLQIEAWDGGRPRRTGLLSVELRVLDENDNPPVFEQDEYRAAVREDAQPGAEVCRVRATDRDLGPNGFVRYSVRARQVPGAGSGGGALGDAAYFAVEELSGVVRVWRPLDREAQAWHQLVVEARDGGAEPEVATVRVSIAVLDVNDNRPAIHVLFLTEGGVARVSEGARPGDYVARVSVSDADGDWEKEDEATGELGVGLGDGSISLSLEGGEGDFALLPGGPPGVFFLCVEGPLDRESRDLYELLLVATDAGSPPLSTEETLLLRVADLNDQPPLFSQQHYKASVSEAAAPGTVVMWVSASDADEAGSDHAWLRYTVVQLSAPCNLGSLQSKMVHTAECGPSFAIDSESGAISTIRTLDREVQEAVELKVVAQDLGEPPLSATCLVSITVDDVNDNEPIFWRQVYNATIAEHAPVGHCFLQLISAQVAFVKIKQKQKEIQEKQNLA

SEQ ID NO: 43053 - protein, 702 aa, Homo sapiens
MGEGRQQRRAPVGKLLLLPGRRDTPHGRSGSSGARTQRSLLWLLVHVWLWAASGSSAQLFNLTLSVDEGLPPDTLVGDIRAGLPAAQQQEGSGFFLSEDSDDSPLLDDFHVHPDTGIIRTARRLDRERRDHYSFVAATLLGAVVQVEIRVNDVNDHSPRFPLDSLQLDVSELSPPGTAFRLPVAHDPDAGLFSTQGYTLVQPSDLPKDPAGPFFQLRYRTPGPLPSPLLPGSSSPLEPLDLVLLRRLDREEAAAHRLQIEAWDGGRPRRTGLLSVELRVLDENDNPPVFEQDEYRAAVREDAQPGAEVCRVRATDRDLGPNGFVRYSVRARQVPGAGSGGGALGDAAYFAVEELSGVVRVWRPLDREAQAWHQLVVEARDGGAEPEVATVRVSIAVLDVNDNRPAIHVLFLTEGGVARVSEGARPGDYVARVSVSDADGDWEKEDEATGELGVGLGDGSISLSLEGGEGDFALLPGGPPGVFFLCVEGPLDRESRDLYELLLVATDAGSPPLSTEETLLLRVADLNDQPPLFSQQHYKASVSEAAAPGTVVMWVSASDADEAGSDHAWLRYTVVQLSAPCNLGSLQSKMVHTAECGPSFAIDSESGAISTIRTLDREVQEAVELKVVAQDLGEPPLSATCLVSITVDDVNDNEPIFWRQVYNATIAEHAPVGHCFLQLISAQVAFVKIKQKQKEIQEKQNLA

SEQ ID NO: 43054 - protein, 1366 aa, Homo sapiens
MSPCGRKMGEGRQQRRAPVGKLLLLPGRRDTPHGRSGSSGARTQRSLLWLLVHVWLWAASGSSAQLFNLTLSVDEGLPPDTLVGDIRAGLPAAQQQEGSGFFLSEDSDDSPLLDDFHVHPDTGIIRTARRLDRERRDHYSFVAATLLGAVVQVEIRVNDVNDHSPRFPLDSLQLDVSELSPPGTAFRLPVAHDPDAGLFSTQGYTLVQPSDLPKDPAGPFFQLRYRTPGPLPSPLLPGSSSPLEPLDLVLLRRLDREEAAAHRLQIEAWDGGRPRRTGLLSVELRVLDENDNPPVFEQDEYRAAVREDAQPGAEVCRVRATDRDLGPNGFVRYSVRARQVPGAGSGGGALGDAAYFAVEELSGVVRVWRPLDREAQAWHQLVVEARDGGAEPEVATVRVSIAVLDVNDNRPAIHVLFLTEGGVARVSEGARPGDYVARVSVSDADGDWEKEDEATGELGVGLGDGSISLSLEGGEGDFALLPGGPPGVFFLCVEGPLDRESRDLYELLLVATDAGSPPLSTEETLLLRVADLNDQPPLFSQQHYKASVSEAAAPGTVVMWVSASDADEAGSDHAWLRYTVVQLSAPCNLGSLQSKMVHTAECGPSFAIDSESGAISTIRTLDREVQEAVELKVVAQDLGEPPLSATCLVSITVDDVNDNEPIFWRQVYNATIAEHAPVGHCFLQVTASDADSGLYGFIEYSLYDGFLSYEAPQAFRIDPHDGQICVSQDIDRERDPATYDLLVEAKDGGGLSAQAFVRVDLEDVNDNHPVFNPSTYVTSISDETQPGTEIINVLATDQDSGIYGTVAYELIPGNVSSLFTIDSTTGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGELINWVALDREHRGHHEMTVLVTDRGSPPRNATMAVYVSVTDINDNRPFFPQCLPGKELHVKVLEGQPVNMLVTTVFAKDPDEGNNAEVTYSVSSARPMPLKGKTAFGKQSCKKQTNKQTKS

SEQ ID NO: 43055 - protein, 153 aa, Homo sapiens
MLEKLMGADSLQLFRSRYTLGKIYFIGFQRSILLSKSENSLNSIAKETEEGRETVTRKEGWKRRHEDGYLEMAQRHLQRSLCPWVSYLPQPYAELEEVSSHVGKVFMARNYEFLAYEASKDRRQPLERMWTCNYNQQKDQSCNHKEITSTKAE

SEQ ID NO: 43056 - protein, 82 aa, Homo sapiens
MAQRHLQRSLCPWVSYLPQPYAELEEVSSHVGKVFMARNYEFLAYEASKDRRQPLERMWTCNYNQQKDQSCNHKEITSTKAE

SEQ ID NO: 43057 - protein, 125 aa, Homo sapiens
MRTAIWKWHRGIYRDHYVLGSLTFLSPMQRAGTSNQWNMGKVMTLDSGDEVTFHKTWPTETGSPYRLEEVSSHVGKVFMARNYEFLAYEASKDRRQPLERMWTCNYNQQKDQSCNHKEITSTKAE

SEQ ID NO: 43058 - protein, 347 aa, Homo sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 43059 - protein, 197 aa, Homo sapiens
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQP

SEQ ID NO: 43060 - protein, 799 aa, Homo sapiens
MKPSPAGTAKELEPPAPARGEQRTAEPEGRWREKGEADTERQRTRERQEATLAGLAELEYLRQRQELLVRGALRGAGGAGAAAPRAGELLGEAAQRSRLEEKFLEENILLLRKQLNCLRRRDAGLLNQLQELDKQISDLRLDVEKTSEEHLETDSRPSSGFYELSDGASGSLSNSSNSVFSECLSSCHSSTCFCSPLEATLSLSDGCPKSADVNPKYQCDLVSKNGNDVYRYPSPLHAVAVQSPMFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHARCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 43061 - protein, 836 aa, Homo sapiens
MKPSPAGTAKELEPPAPARGEQRTAEPEGRWREKGEADTERQRTRERQEATLAGLAELEYLRQRQELLVRGALRGAGGAGAAAPRAGELLGEAAQRSRLEEKFLEENILLLRKQLNCLRRRDAGLLNQLQELDKQISDLRLDVEKTSEEHLETDSRPSSGFYELSDGASGSLSNSSNSVFSECLSSCHSSTCFCSPLEATLSLSDGCPKSADLIGLLEYKEGHCEDQASGAVCRSLSTPQFNSLDVIADVNPKYQCDLVSKNGNDVYRYPSPLHAVAVQSPMFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHARCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 43062 - protein, 774 aa, Homo sapiens
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQRQGGWSTDGGGRLLVFAPGREDEGGPAQSRGAGRGGPQQQGYMPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 43063 - protein, 280 aa, Homo sapiens
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTELCNAPGELDMHAPPAGCTSSSLTGVGSGLRGKCGLCGCQLPFCSVNTSSKTKSSGISRQQ

SEQ ID NO: 43064 - protein, 629 aa, Homo sapiens
MIRAFSFPVSPERGRLRGWLEGSLAGLCELHWLRERQEYRVQQALRLAQPGMGGAEAEDEEDADEDEDAAAARRAAAALEEQLEALPGLVWDLGQQLGDLSLESGGLEQESGRSSGFYEDPSSTGGPDSPPSTFCGDSGFSGSSSYGRLGPSEPRGIYASERPKSLGDASPSAPEVVGARAAVPRSFSAPYPTAGGSAGPEACSSAERRARAGPFLTPSPLHAVAMRSPRPCGRPPTDSPDAGGAGRPLDGYISALLRRRRRRGAGQPRTSPGGADGGPRRQNSVRQRPPDASPSPGSARPAREPSLERVGGHPTSPAALSRAWASSWESEAAPEPAAPPAAPSPPDSPAEGRLVKAQYIPGAQAATRGLPGRAARRKPPPLTRGRSVEQSPPRERPRAAGRRGRMAEASGRRGSPRARKASRSQSETSLLGRASAVPSGPPKYPTAEREEPRPPRPRRGPAPTLAAQAAGSCRRWRSTAEIDAADGRRVRPRAPAARVPGPGPSPSAPQRRLLYGCAGSDSECSAGRLGPLGRRGPAGGVGGGYGESESSASEGESPAFSSASSDSDGSGGLVWPQQLVAATAASGGGAGAGAPAGPAKVFVKIKASHALKKKILRFRSGSLKVMTTV

SEQ ID NO: 43065 - protein, 674 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQLYRPFYLQLTNMPFINYSIQKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 43066 - protein, 217 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRKALQSI

SEQ ID NO: 43067 - protein, 615 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASVTQGRAAGQQRWTESLDGVMGPPASHTCVSATTLLPALPKGSREQGCLCPCPASFTQSHLVTSLALLPGEWSPAEDMPLHPSQENSFAPADIPVKGPLLFPEARPWLMSARCWVRPFPFVTWGCLIPHDTTPLHEEVSPCPCLRLGYLYLLLTQSLWCRVRVPSLSTAGPIPRTSHPCTLAFPSYLNDHDLGHLCQAKPQGWNTPQPFLHCGFLAVDSG

SEQ ID NO: 43068 - protein, 431 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASVTQGRAAGQQRWTESLDGVMGPPASHTCHRPCRLP

SEQ ID NO: 43069 - protein, 157 aa, Homo sapiens
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQK

SEQ ID NO: 43070 - protein, 189 aa, Homo sapiens
MVGGGQPCGPNMSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 43071 - protein, 178 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 43072 - protein, 169 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSI

SEQ ID NO: 43073 - protein, 73 aa, Homo sapiens
MSEVSCKKRDDYLEWPEYFMAVAFLSAQRSKDPNSQVGACIVNSENKIVGIGYNGMPNGCSDDVLPWRRTAEN

SEQ ID NO: 43074 - protein, 59 aa, Homo sapiens
MSEVSCKKRDDYLEWPEYFMAVAFLSAQRSKDPNSQVGACIVNSENKIVGIGYNGMPNG

SEQ ID NO: 43075 - protein, 23 aa, Homo sapiens
MSEVSCKKRDDYLEWPEYFMAVA

SEQ ID NO: 43076 - protein, 120 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQA

SEQ ID NO: 43077 - protein, 178 aa, Homo sapiens; identical to SEQ ID NO: 43071

SEQ ID NO: 43078 - protein, 119 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQ

SEQ ID NO: 43079 - protein, 98 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDV

SEQ ID NO: 43080 - protein, 259 aa, Homo sapiens
MNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 43081 - protein, 219 aa, Homo sapiens
MNKLKSSQKDKVRQFMIFTQSSEKTAVSCLSQNDWKLDVATDNFFQNPELYIRESVKGSLDRKKLEQLYNRYKDPQDENKIGIDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 43082 - protein, 128 aa, Homo sapiens
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPK

SEQ ID NO: 43083 - protein, 292 aa, Homo sapiens
MHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 43084 - protein, 232 aa, Homo sapiens
MPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 43085 - protein, 257 aa, Homo sapiens
MHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARQSKYKVINKDQWCNVLEFSRTINLDLSNYDEDGAWPVLLDEFVEWYKDKQMS

SEQ ID NO: 43086 - protein, 336 aa, Homo sapiens
MEVEAALGCSGQGRGCGGVAPAGRGRERASERGTRVRISKGLSGAGGSVRKADFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 43087 - protein, 617 aa, Homo sapiens
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 43088 - protein, 515 aa, Homo sapiens
MQIKVSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 43089 - protein, 420 aa, Homo sapiens
METKRVEIPGSVLDDFCSRFILHIPSEERDNAIRVCFQIELAHWFYLDFYMQNTPGLPQCGIRDFAKAVFSHCPFLLPQGEDVEKVLDEWKEYKMGVPTYGAIILDETLENVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 43090 - protein, 385 aa, Homo sapiens
METKRVEIPGSVLDDFCSRFILHIPSEERDNAIRVCFQIELAHWFYLDFYMQNTPGLPQCGIRDFAKAVFSHCPFLLPQGEDVEKVLDEWKEYKMGVPTYGAIILDETLENVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKKCEKKLHPRKLQDNFETDAVYDLPSSSEDQLLEHAEGQPVACNGHCKFPFSSRAFLSFKFDHNAIMKILDL

SEQ ID NO: 43091 - protein, 209 aa, Homo sapiens
MTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 43092 - protein, 446 aa, Homo sapiens
MTELGMVVLGIDTTHLWMLPLTPGSWNSMRSRHKWNWPQGSWGLGGPPRSTAFLECCTSFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 43093 - protein, 520 aa, Homo sapiens
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 43094 - protein, 546 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 43095 - protein, 122 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGL

SEQ ID NO: 43096 - protein, 73 aa, Homo sapiens
MGSRNSSSAGSGSGDPSEGLPRRGAGLRRSEEEEEEDEDVDLAQVLAYLLRRGQVRLVQGGGAANLQFIQALL

SEQ ID NO: 43097 - protein, 93 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNP

SEQ ID NO: 43098 - protein, 108 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNE

SEQ ID NO: 43099 - protein, 546 aa, Homo sapiens; identical to SEQ ID NO: 43094

SEQ ID NO: 43100 - protein, 90 aa, Homo sapiens
MGSRNSSSAGSGSGDPSEGLPRRGAGLRRSEEEEEEDEDVDLAQALLDSEEENDRAWDGRLGDRYNPPVDATPDTRELEFNEIKTQVELA

SEQ ID NO: 43101 - protein, 30 aa, Homo sapiens
MGSRNSSSAGSGSGDPSEGLPRRGAGLRRS

SEQ ID NO: 43102 - protein, 142 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGL

SEQ ID NO: 43103 - protein, 67 aa, Homo sapiens
MGSRNSSSAGSGSGDPSEGLPRRGAGLRRSEEEEEEDEDVDLAQRPSEVGAGRRCSKFTIHSGPLGL

SEQ ID NO: 43104 - protein, 106 aa, Homo sapiens
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGLGG

SEQ ID NO: 43105 - protein, 128 aa, Homo sapiens
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQS

SEQ ID NO: 43106 - protein, 154 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQS

SEQ ID NO: 43107 - protein, 942 aa, Homo sapiens
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 43108 - protein, 860 aa, Homo sapiens
MEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 43109 - protein, 210 aa, Homo sapiens
MEQAIHSRVKPIQLKGEHHSNIFCLAFNSGNTKVFSGGNDEQVILHDVESETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQ

SEQ ID NO: 43110 - protein, 860 aa, Homo sapiens; identical to SEQ ID NO: 43108

SEQ ID NO: 43111 - protein, 118 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 43112 - protein, 118 aa, Homo sapiens; identical to SEQ ID NO: 43111

SEQ ID NO: 43113 - protein, 132 aa, Homo sapiens
MQLFLLAVSVPLPAMPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 43114 - protein, 134 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRFPTVLSTSPAAHGGPRCPGEIIEGKKSCLNEEALFIYFI

SEQ ID NO: 43115 - protein, 740 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 43116 - protein, 740 aa, Homo sapiens; identical to SEQ ID NO: 43115

SEQ ID NO: 43117 - protein, 16 aa, Homo sapiens
MAAFSEMGVMPEIAQA

SEQ ID NO: 43118 - protein, 622 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHMVQRDAVTI

SEQ ID NO: 43119 - protein, 875 aa, Homo sapiens
MGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVLEALYRLQWTSTDGLGVLIISPTRELAYQTFEVLRKVGKNHDFSAGLIIGGKDLKHEAERINNINILVCTPGRLLQHMDETVSFHATDLQMLVLDEADRILDMGFADTMNAVIENLPKKRQTLLFSATQTKSVKDLARLSLKNPEYVWVHEKAKYSTPATLEQNYIVCELQQKISVLYSFLRSHLKKKSIVFFSSCKEVQYLYRVFCRLRPGVSILALHGRQQQMRRMEVYNEFVRKRAAVLFATDIAARGLDFPAVNWVLQFDCPEDANTYIHRAGRTARYKEDGEALLILLPSEKAMVQQLLQKKVPVKEIKINPEKLIDVQKKLESILAQDQDLKERAQRCFVSYVRSVYLMKDKEVFDVSKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 43120 - protein, 781 aa, Homo sapiens
MGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVNEADRILDMGFADTMNAVIENLPKKRQTLLFSATQTKSVKDLARLSLKNPEYVWVHEKAKYSTPATLEQNYIVCELQQKISVLYSFLRSHLKKKSIVFFSSCKEVQYLYRVFCRLRPGVSILALHGRQQQMRRMEVYNEFVRKRAAVLFATDIAARGLDFPAVNWVLQFDCPEDANTYIHRAGRTARYKEDGEALLILLPSEKAMVQQLLQKKVPVKEIKINPEKLIDVQKKLESILAQDQDLKERAQRCFVSYVRSVYLMKDKEVFDVSKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 43121 - protein, 652 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLGFDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 43122 - protein, 731 aa, Homo sapiens
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGKGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 43123 - protein, 729 aa, Homo sapiens
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 43124 - protein, 737 aa, Homo sapiens
PNLPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGKGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNTLLLLPLLLLHVNETTQVVVTPADLITF

SEQ ID NO: 43125 - protein, 181 aa, Homo sapiens
MQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 43126 - protein, 670 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 43127 - protein, 409 aa, Homo sapiens
MEQEQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 43128 - protein, 824 aa, Homo sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQRVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 43129 - protein, 138 aa, Homo sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQAELSNS

SEQ ID NO: 43130 - protein, 783 aa, Homo sapiens
MPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 43131 - protein, 82 aa, Homo sapiens
MPGKLRSDAGLESDTAMKKGETLRKQTEEKEKKEKPKSDKTEEIAEEEETVFPKAKQVKKKAEPSEVDMNSPKSKKKKKKKK

SEQ ID NO: 43132 - protein, 820 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 43133 - protein, 138 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPK

SEQ ID NO: 43134 - protein, 182 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVE

SEQ ID NO: 43135 - protein, 859 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 43136 - protein, 804 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 43137 - protein, 763 aa, Homo sapiens
MDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPQPSTSAN

SEQ ID NO: 43138 - protein, 485 aa, Homo sapiens
MTKAPCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 43139 - protein, 540 aa, Homo sapiens
MALTRPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 43140 - protein, 662 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 43141 - protein, 139 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGYGGFYNSDGYGGNYNSQGVDWWGN

SEQ ID NO: 43142 - protein, 646 aa, Homo sapiens
MSHVAVENALGLDQQFAGLDLNSSDNQSGGSTASSFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 43143 - protein, 308 aa, Homo sapiens
MRESRLISDLGGFAGVRSAAGRDWRPFWLGGLRPSRLAQPGFPSGGPGGTRCLRACEQGFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGKWKVWAPQTIPNLLGISTNERVGSTDLRGSQKIFIPI

SEQ ID NO: 43144 - protein, 660 aa, Homo sapiens
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 43145 - protein, 660 aa, Homo sapiens; identical to SEQ ID NO: 43144

SEQ ID NO: 43146 - protein, 250 aa, Homo sapiens
MEIGRPRKDTWKLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVK

SEQ ID NO: 43147 - protein, 224 aa, Homo sapiens
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQT

SEQ ID NO: 43148 - protein, 657 aa, Homo sapiens
MEIGRPRKDTWKLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 43149 - protein, 425 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRCYPLSPSRWPEQAGLAPRAWLSHLCPMRMMPRSSMMCRIALRSILVSCLMR

SEQ ID NO: 43150 - protein, 428 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 43151 - protein, 428 aa, Homo sapiens; identical to SEQ ID NO: 43150

SEQ ID NO: 43152 - protein, 425 aa, Homo sapiens; identical to SEQ ID NO: 43149

SEQ ID NO: 43153 - protein, 428 aa, Homo sapiens; identical to SEQ ID NO: 43150

SEQ ID NO: 43154 - protein, 428 aa, Homo sapiens; identical to SEQ ID NO: 43150

SEQ ID NO: 43155 - protein, 187 aa, Homo sapiens
MGSSHIGGLSINERRCSASLGLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKN

SEQ ID NO: 43156 - protein, 428 aa, Homo sapiens; identical to SEQ ID NO: 43150

SEQ ID NO: 43157 - protein, 125 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTREL

SEQ ID NO: 43158 - protein, 428 aa, Homo sapiens; identical to SEQ ID NO: 43150

SEQ ID NO: 43159 - protein, 187 aa, Homo sapiens
  MOD_RES (1)..(1): Any amino acid
XSEERDIGKPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSY

SEQ ID NO: 43160 - protein, 125 aa, Homo sapiens; identical to SEQ ID NO: 43157

SEQ ID NO: 43161 - protein, 428 aa, Homo sapiens; identical to SEQ ID NO: 43150

SEQ ID NO: 43162 - protein, 289 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQ

SEQ ID NO: 43163 - protein, 428 aa, Homo sapiens; identical to SEQ ID NO: 43150

SEQ ID NO: 43164 - protein, 96 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKT

SEQ ID NO: 43165 - protein, 125 aa, Homo sapiens; identical to SEQ ID NO: 43157

SEQ ID NO: 43166 - protein, 231 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATL

SEQ ID NO: 43167 - protein, 132 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVCFCDSHFPRGDNEELHLP

SEQ ID NO: 43168 - protein, 350 aa, Homo sapiens
MWTMSSWTMKMMRWRQQLGEMGLRPLPRRMSRAPMSPSTALAFVTSCSSQSCSGPLSTVALSIRQKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 43169 - protein, 245 aa, Homo sapiens
MWTMSSWTMKMMRWRQQLGEMGLRPLPRRMSRAPMSPSTALAFVTSCSSQSCSGPLSTVALSIRQKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQ

SEQ ID NO: 43170 - protein, 136 aa, Homo sapiens
MGGGRRPYDVFFSKVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCH

SEQ ID NO: 43171 - protein, 428 aa, Homo sapiens; identical to SEQ ID NO: 43150

SEQ ID NO: 43172 - protein, 197 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVCFCDSHFPRGDNEELHLPYVSVYFLPKVSVLVMCHTRELAFQISKEYERFSKYMPNVKVAVFFGGLSIKKDEEVLKKNCPHIV

SEQ ID NO: 43173 - protein, 189 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQ

SEQ ID NO: 43174 - protein, 428 aa, Homo sapiens; identical to SEQ ID NO: 43150

SEQ ID NO: 43175 - protein, 236 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIR

SEQ ID NO: 43176 - protein, 187 aa, Homo sapiens
MGSSHIGGLSINERRRSASLGLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKN

SEQ ID NO: 43177 - protein, 132 aa, Homo sapiens; identical to SEQ ID NO: 43167

SEQ ID NO: 43178 - protein, 443 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVYLGRVLGRGFWCVFVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 43179 - protein, 289 aa, Homo sapiens; identical to SEQ ID NO: 43162

SEQ ID NO: 43180 - protein, 187 aa, Homo sapiens; identical to SEQ ID NO: 43159
  MOD_RES (1)..(1): Any amino acid

SEQ ID NO: 43181 - protein, 136 aa, Homo sapiens; identical to SEQ ID NO: 43170

SEQ ID NO: 43182 - protein, 136 aa, Homo sapiens; identical to SEQ ID NO: 43170

SEQ ID NO: 43183 - protein, 132 aa, Homo sapiens; identical to SEQ ID NO: 43167

SEQ ID NO: 43184 - protein, 236 aa, Homo sapiens; identical to SEQ ID NO: 43175

SEQ ID NO: 43185 - protein, 125 aa, Homo sapiens; identical to SEQ ID NO: 43157

SEQ ID NO: 43186 - protein, 328 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 43187 - protein, 236 aa, Homo sapiens; identical to SEQ ID NO: 43175

SEQ ID NO: 43188 - protein, 187 aa, Homo sapiens; identical to SEQ ID NO: 43159
  MOD_RES (1)..(1): Any amino acid

SEQ ID NO: 43189 - protein, 125 aa, Homo sapiens; identical to SEQ ID NO: 43157

SEQ ID NO: 43190 - protein, 96 aa, Homo sapiens; identical to SEQ ID NO: 43164

SEQ ID NO: 43191 - protein, 125 aa, Homo sapiens; identical to SEQ ID NO: 43157

SEQ ID NO: 43192 - protein, 328 aa, Homo sapiens; identical to SEQ ID NO: 43186
  MOD_RES (1)..(1): Any amino acid

SEQ ID NO: 43193 - protein, 289 aa, Homo sapiens; identical to SEQ ID NO: 43162

SEQ ID NO: 43194 - protein, 245 aa, Homo sapiens; identical to SEQ ID NO: 43169

SEQ ID NO: 43195 - protein, 245 aa, Homo sapiens; identical to SEQ ID NO: 43169

SEQ ID NO: 43196 - protein, 131 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATL

SEQ ID NO: 43197 - protein, 136 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIR

SEQ ID NO: 43198 - protein, 238 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPV

SEQ ID NO: 43199 - protein, 187 aa, Homo sapiens; identical to SEQ ID NO: 43159
  MOD_RES (1)..(1): Any amino acid

SEQ ID NO: 43200 - protein, 197 aa, Homo sapiens; identical to SEQ ID NO: 43172

SEQ ID NO: 43201 - protein, 197 aa, Homo sapiens; identical to SEQ ID NO: 43172

SEQ ID NO: 43202 - protein, 136 aa, Homo sapiens; identical to SEQ ID NO: 43170

SEQ ID NO: 43203 - protein, 425 aa, Homo sapiens; identical to SEQ ID NO: 43149

SEQ ID NO: 43204 - protein, 428 aa, Homo sapiens; identical to SEQ ID NO: 43150

SEQ ID NO: 43205 - protein, 428 aa, Homo sapiens; identical to SEQ ID NO: 43150

SEQ ID NO: 43206 - protein, 245 aa, Homo sapiens; identical to SEQ ID NO: 43169

SEQ ID NO: 43207 - protein, 231 aa, Homo sapiens; identical to SEQ ID NO: 43166

SEQ ID NO: 43208 - protein, 197 aa, Homo sapiens; identical to SEQ ID NO: 43172

SEQ ID NO: 43209 - protein, 197 aa, Homo sapiens; identical to SEQ ID NO: 43172

SEQ ID NO: 43210 - protein, 179 aa, Homo sapiens
VAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQ

SEQ ID NO: 43211 - protein, 197 aa, Homo sapiens; identical to SEQ ID NO: 43172

SEQ ID NO: 43212 - protein, 187 aa, Homo sapiens; identical to SEQ ID NO: 43159
  MOD_RES (1)..(1): Any amino acid

SEQ ID NO: 43213 - protein, 64 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKN

SEQ ID NO: 43214 - protein, 25 aa, Homo sapiens
  MOD_RES (1)..(1): Any amino acid
XATLQQLEPVTGQVSVLVMCHTREL

SEQ ID NO: 43215 - protein, 21 aa, Homo sapiens
  MOD_RES (1)..(1): Any amino acid
XATLQQLEPVTGQVSVLVMCH

SEQ ID NO: 43216 - protein, 289 aa, Homo sapiens; identical to SEQ ID NO: 43162

SEQ ID NO: 43217 - protein, 236 aa, Homo sapiens; identical to SEQ ID NO: 43175

SEQ ID NO: 43218 - protein, 236 aa, Homo sapiens; identical to SEQ ID NO: 43175

SEQ ID NO: 43219 - protein, 325 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRCYPLSPSRWPEQAGLAPRAWLSHLCPMRMMPRSSMMCRIALRSILVSCLMR

SEQ ID NO: 43220 - protein, 238 aa, Homo sapiens; identical to SEQ ID NO: 43198

SEQ ID NO: 43221 - protein, 238 aa, Homo sapiens; identical to SEQ ID NO: 43198

SEQ ID NO: 43222 - protein, 289 aa, Homo sapiens; identical to SEQ ID NO: 43162

SEQ ID NO: 43223 - protein, 425 aa, Homo sapiens; identical to SEQ ID NO: 43149

SEQ ID NO: 43224 - protein, 136 aa, Homo sapiens; identical to SEQ ID NO: 43170

SEQ ID NO: 43225 - protein, 187 aa, Homo sapiens; identical to SEQ ID NO: 43155

SEQ ID NO: 43226 - protein, 132 aa, Homo sapiens; identical to SEQ ID NO: 43167

SEQ ID NO: 43227 - protein, 289 aa, Homo sapiens; identical to SEQ ID NO: 43162

SEQ ID NO: 43228 - protein, 428 aa, Homo sapiens; identical to SEQ ID NO: 43150

SEQ ID NO: 43229 - protein, 187 aa, Homo sapiens; identical to SEQ ID NO: 43155

SEQ ID NO: 43230 - protein, 96 aa, Homo sapiens; identical to SEQ ID NO: 43164

SEQ ID NO: 43231 - protein, 187 aa, Homo sapiens; identical to SEQ ID NO: 43155

SEQ ID NO: 43232 - protein, 197 aa, Homo sapiens; identical to SEQ ID NO: 43172

SEQ ID NO: 43233 - protein, 96 aa, Homo sapiens; identical to SEQ ID NO: 43164

SEQ ID NO: 43234 - protein, 231 aa, Homo sapiens; identical to SEQ ID NO: 43166

SEQ ID NO: 43235 - protein, 231 aa, Homo sapiens; identical to SEQ ID NO: 43166

SEQ ID NO: 43236 - protein, 238 aa, Homo sapiens; identical to SEQ ID NO: 43198

SEQ ID NO: 43237 - protein, 428 aa, Homo sapiens; identical to SEQ ID NO: 43150

SEQ ID NO: 43238 - protein, 187 aa, Homo sapiens; identical to SEQ ID NO: 43159
  MOD_RES (1)..(1): Any amino acid

SEQ ID NO: 43239 - protein, 187 aa, Homo sapiens; identical to SEQ ID NO: 43155

SEQ ID NO: 43240 - protein, 238 aa, Homo sapiens; identical to SEQ ID NO: 43198

SEQ ID NO: 43241 - protein, 245 aa, Homo sapiens; identical to SEQ ID NO: 43169

SEQ ID NO: 43242 - protein, 425 aa, Homo sapiens; identical to SEQ ID NO: 43149

SEQ ID NO: 43243 - protein, 236 aa, Homo sapiens; identical to SEQ ID NO: 43175

SEQ ID NO: 43244 - protein, 245 aa, Homo sapiens; identical to SEQ ID NO: 43169

SEQ ID NO: 43245 - protein, 428 aa, Homo sapiens; identical to SEQ ID NO: 43150

SEQ ID NO: 43246 - protein, 136 aa, Homo sapiens; identical to SEQ ID NO: 43170

SEQ ID NO: 43247 - protein, 328 aa, Homo sapiens; identical to SEQ ID NO: 43186
  MOD_RES (1)..(1): Any amino acid

SEQ ID NO: 43248 - protein, 132 aa, Homo sapiens; identical to SEQ ID NO: 43167

SEQ ID NO: 43249 - protein, 139 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQSHEHMTSVTLDNLTAVGDVLSQAWGS

SEQ ID NO: 43250 - protein, 238 aa, Homo sapiens; identical to SEQ ID NO: 43198

SEQ ID NO: 43251 - protein, 187 aa, Homo sapiens; identical to SEQ ID NO: 43176

SEQ ID NO: 43252 - protein, 236 aa, Homo sapiens; identical to SEQ ID NO: 43175

SEQ ID NO: 43253 - protein, 425 aa, Homo sapiens; identical to SEQ ID NO: 43149

SEQ ID NO: 43254 - protein, 231 aa, Homo sapiens; identical to SEQ ID NO: 43166

SEQ ID NO: 43255 - protein, 32 aa, Homo sapiens
  MOD_RES (1)..(1): Any amino acid
XATLQQLEPVTGQVCFCDSHFPRGDNEELHLP

SEQ ID NO: 43256 - protein, 132 aa, Homo sapiens; identical to SEQ ID NO: 43167

SEQ ID NO: 43257 - protein, 132 aa, Homo sapiens; identical to SEQ ID NO: 43167

SEQ ID NO: 43258 - protein, 245 aa, Homo sapiens; identical to SEQ ID NO: 43169

SEQ ID NO: 43259 - protein, 231 aa, Homo sapiens; identical to SEQ ID NO: 43166

SEQ ID NO: 43260 - protein, 243 aa, Homo sapiens
MWTMSSWTMKMMRWRQQLGEMGLRPLPRRMSRAPMSPSTALAFVTSCSSQSCSGPLSTVALSIRQKVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDVNTLLPSLPPLPARCLLPFLALFLRLPCHSSAKKAACAQLGVMTP

SEQ ID NO: 43261 - protein, 428 aa, Homo sapiens; identical to SEQ ID NO: 43150

SEQ ID NO: 43262 - protein, 425 aa, Homo sapiens; identical to SEQ ID NO: 43149

SEQ ID NO: 43263 - protein, 96 aa, Homo sapiens; identical to SEQ ID NO: 43164

SEQ ID NO: 43264 - protein, 136 aa, Homo sapiens; identical to SEQ ID NO: 43170

SEQ ID NO: 43265 - protein, 187 aa, Homo sapiens; identical to SEQ ID NO: 43159
  MOD_RES (1)..(1): Any amino acid

SEQ ID NO: 43266 - protein, 238 aa, Homo sapiens; identical to SEQ ID NO: 43198

SEQ ID NO: 43267 - protein, 138 aa, Homo sapiens
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPV

SEQ ID NO: 43268 - protein, 289 aa, Homo sapiens; identical to SEQ ID NO: 43162

SEQ ID NO: 43269 - protein, 428 aa, Homo sapiens; identical to SEQ ID NO: 43150

SEQ ID NO: 43270 - protein, 231 aa, Homo sapiens; identical to SEQ ID NO: 43166

SEQ ID NO: 43271 - protein, 428 aa, Homo sapiens; identical to SEQ ID NO: 43150

SEQ ID NO: 43272 - protein, 125 aa, Homo sapiens; identical to SEQ ID NO: 43157

SEQ ID NO: 43273 - protein, 97 aa, Homo sapiens
  MOD_RES (1)..(1): Any amino acid
XATLQQLEPVTGQVCFCDSHFPRGDNEELHLPYVSVYFLPKVSVLVMCHTRELAFQISKEYERFSKYMPNVKVAVFFGGLSIKKDEEVLKKNCPHIV

SEQ ID NO: 43274 - protein, 96 aa, Homo sapiens; identical to SEQ ID NO: 43164

SEQ ID NO: 43275 - protein, 96 aa, Homo sapiens; identical to SEQ ID NO: 43164

SEQ ID NO: 43276 - protein, 428 aa, Homo sapiens; identical to SEQ ID NO: 43150

SEQ ID NO: 43277 - protein, 243 aa, Homo sapiens; identical to SEQ ID NO: 43260

SEQ ID NO: 43278 - protein, 323 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQEITCKSVQRFSTTNSCGYQPIWPRHGHRAGEHCF

SEQ ID NO: 43279 - protein, 323 aa, Homo sapiens; identical to SEQ ID NO: 43278

SEQ ID NO: 43280 - protein, 443 aa, Homo sapiens; identical to SEQ ID NO: 43178

SEQ ID NO: 43281 - protein, 243 aa, Homo sapiens; identical to SEQ ID NO: 43260

SEQ ID NO: 43282 - protein, 443 aa, Homo sapiens; identical to SEQ ID NO: 43178

SEQ ID NO: 43283 - protein, 139 aa, Homo sapiens; identical to SEQ ID NO: 43249

SEQ ID NO: 43284 - protein, 243 aa, Homo sapiens; identical to SEQ ID NO: 43260

SEQ ID NO: 43285 - protein, 243 aa, Homo sapiens; identical to SEQ ID NO: 43260

SEQ ID NO: 43286 - protein, 139 aa, Homo sapiens; identical to SEQ ID NO: 43249

SEQ ID NO: 43287 - protein, 323 aa, Homo sapiens; identical to SEQ ID NO: 43278

SEQ ID NO: 43288 - protein, 443 aa, Homo sapiens; identical to SEQ ID NO: 43178

SEQ ID NO: 43289 - protein, 243 aa, Homo sapiens; identical to SEQ ID NO: 43260

SEQ ID NO: 43290 - protein, 350 aa, Homo sapiens; identical to SEQ ID NO: 43168

SEQ ID NO: 43291 - protein, 443 aa, Homo sapiens; identical to SEQ ID NO: 43178

SEQ ID NO: 43292 - protein, 350 aa, Homo sapiens; identical to SEQ ID NO: 43168

SEQ ID NO: 43293 - protein, 243 aa, Homo sapiens; identical to SEQ ID NO: 43260

SEQ ID NO: 43294 - protein, 139 aa, Homo sapiens; identical to SEQ ID NO: 43249

SEQ ID NO: 43295 - protein, 350 aa, Homo sapiens; identical to SEQ ID NO: 43168

SEQ ID NO: 43296 - protein, 323 aa, Homo sapiens; identical to SEQ ID NO: 43278

SEQ ID NO: 43297 - protein, 350 aa, Homo sapiens; identical to SEQ ID NO: 43168

SEQ ID NO: 43298 - protein, 139 aa, Homo sapiens; identical to SEQ ID NO: 43249

SEQ ID NO: 43299 - protein, 443 aa, Homo sapiens; identical to SEQ ID NO: 43178

SEQ ID NO: 43300 - protein, 323 aa, Homo sapiens; identical to SEQ ID NO: 43278

SEQ ID NO: 43301 - protein, 323 aa, Homo sapiens; identical to SEQ ID NO: 43278

SEQ ID NO: 43302 - protein, 350 aa, Homo sapiens; identical to SEQ ID NO: 43168

SEQ ID NO: 43303 - protein, 139 aa, Homo sapiens; identical to SEQ ID NO: 43249

SEQ ID NO: 43304 - protein, 350 aa, Homo sapiens; identical to SEQ ID NO: 43168

SEQ ID NO: 43305 - protein, 139 aa, Homo sapiens; identical to SEQ ID NO: 43249

SEQ ID NO: 43306 - protein, 443 aa, Homo sapiens; identical to SEQ ID NO: 43178

SEQ ID NO: 43307 - protein, 183 aa, Homo sapiens
MEIFVDDETKLTLHGLQQYYVKLKDNEKNRKLFDLLDVLEFNQVVIFVKSVQRCIALAQLLVEQNFPAIAIHRGMPQEERWLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 43308 - protein, 690 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGDNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 43309 - protein, 690 aa, Homo sapiens; identical to SEQ ID NO: 43308

SEQ ID NO: 43310 - protein, 724 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 43311 - protein, 105 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGD

SEQ ID NO: 43312 - protein, 704 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 43313 - protein, 159 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGG

SEQ ID NO: 43314 - protein, 575 aa, Homo sapiens
MGSRNLFLTNSPESSNDCEDNPTRNRGFSKRGDNDLDPDECMQRTGGLFGSRRPVLSGTGNGDTSQSRSGSGSERDSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 43315 - protein, 622 aa, Homo sapiens
MEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 43316 - protein, 626 aa, Homo sapiens
MHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPPPKRKKSRWDS

SEQ ID NO: 43317 - protein, 938 aa, Homo sapiens
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 43318 - protein, 938 aa, Homo sapiens; identical to SEQ ID NO: 43317

SEQ ID NO: 43319 - protein, 938 aa, Homo sapiens; identical to SEQ ID NO: 43317

SEQ ID NO: 43320 - protein, 938 aa, Homo sapiens; identical to SEQ ID NO: 43317

SEQ ID NO: 43321 - protein, 648 aa, Homo sapiens
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFKAHQQKREMERKMERPQGRPKKFH

SEQ ID NO: 43322 - protein, 195 aa, Homo sapiens
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWAGKKILI

SEQ ID NO: 43323 - protein, 603 aa, Homo sapiens
MSGYSSDRDRGRDRGFGAPRFGGSRAGPLSGKKFGNPGEKLVKKKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 43324 - protein, 544 aa, Homo sapiens
MSGYSSDRDRGRDRGFGAPRFGGSRAGPLSGKKFGNPGEKLVKKKWNLDELPKFEKNFYQEHPDLARRTAQEVETYRYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 43325 - protein, 614 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 43326 - protein, 599 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAMRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 43327 - protein, 491 aa, Homo sapiens
MSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAMRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 43328 - protein, 881 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQGASRPHAPGTPAGRVRPELKTKQQILKQRRRAQKLHFLQRGGLKQLSARNRRRVQELQQGAFGRGARSKKGKMRKRM

SEQ ID NO: 43329 - protein, 882 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 43330 - protein, 483 aa, Homo sapiens
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 43331 - protein, 483 aa, Homo sapiens; identical to SEQ ID NO: 43330

SEQ ID NO: 43332 - protein, 483 aa, Homo sapiens; identical to SEQ ID NO: 43330

SEQ ID NO: 43333 - protein, 187 aa, Homo sapiens [sequence omitted]

SEQ ID NO: 43334 - protein, 1712 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 43335 - protein, 120 aa, Homo sapiens
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVR

SEQ ID NO: 43336 - protein, 294 aa, Homo sapiens
MIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKNQKCGSKPNT

SEQ ID NO: 43337 - protein, 353 aa, Homo sapiens
MQSKRDCELWCERVNPENKAALEAWVRETGIRLVQVNGQRKYGGPPPGWVGSPPPAGSEVFIGRLPQDVYEHQLIPLFQRVGRLYEFRLMMTFSGLNRGFAYARYSSRRGAQAAIATLHNHPLRPSCPLLVCRSTEKCELSVDGLPPNLTRSALLLALQPLGPGLQEARLLPSPGPAPGQIALLKFSSHRAAAMAKKALVEGQSHLCGEQVAVEWLKPDLKQRLRQQLVGPFLRSPQPEGSQLALARDKLGFQGARATLQLLCQRMKLGSPVFLTKCLGIGPAGWHRFWYQVVIPGHPVPFSGLIWVVLTLDGRDGHEVAKDAVSVRLLQALSESGANLLWSAGAEAGTMVKQ

SEQ ID NO: 43338 - protein, 496 aa, Homo sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 43339 - protein, 496 aa, Homo sapiens; identical to SEQ ID NO: 43338

SEQ ID NO: 43340 - protein, 332 aa, Homo sapiens
MQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 43341 - protein, 332 aa, Homo sapiens; identical to SEQ ID NO: 43340

SEQ ID NO: 43342 - protein, 524 aa, Homo sapiens
MANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSHLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 43343 - protein, 907 aa, Homo sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPRARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSHLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 43344 - protein, 345 aa, Homo sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVSGVGKGGQPLRHRILPPNPEQQSCLEAARRGWFCPGSVFPQVCTEGWCFFFAFLFDLCSVCYNTG

SEQ ID NO: 43345 - protein, 556 aa, Homo sapiens
MHGSLEALLFLPQVTLSLAHAHLICSNAQLEMCVFPHRFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSHLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 43346 - protein, 352 aa, Homo sapiens
MFAAATKSFVKQVGDGGRLVPVPSLSEADKYQPLSLVVKKKRCFLFPRYKFTSTPFTLKDILLGDREISAGISSYQLLNYEDESDVSLYGRRGNHIVNDVGINVAGSDSIAVKASFGIVTKHEVEVSTLLKEITTRKINFDHSLIRQSRSSRKAVLCVVMESIRTTRQCSLSVHAGIRGEAMRFHFMDEQNPKGRDKAIVFPAHTTIAFSVFELFIYLDGAFDLCVTSVSKGGFEREETATFALLYRLRNILFERNRRVMDVISRSQLYLDDLFSDYYDKPLSMTDISLKEGTHIRVNLLNHNIPKGPCILCGMGNFKRETVYGCFQCSVDGQKYVRLHAVPCFDIWHKRMK

SEQ ID NO: 43347 - protein, 352 aa, Homo sapiens; identical to SEQ ID NO: 43346

SEQ ID NO: 43348 - protein, 795 aa, Homo sapiens
MSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 43349 - protein, 784 aa, Homo sapiens
MSKRHRLDLGEDYPSGKKRAGTDGKDRDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 43350 - protein, 560 aa, Homo sapiens
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 43351 - protein, 1041 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 43352 - protein, 560 aa, Homo sapiens
MESQPAQECLMQMFLPIEPACFVEWLGTSPSQLGVVMVDEAHERTLHTDILFGLIKDVARFRPELKVLVASATMDTARFSTFFDGAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 43353 - protein, 1041 aa, Homo sapiens [sequence omitted]

SEQ ID NO: 43354 - protein, 560 aa, Homo sapiens; identical to SEQ ID NO: 43350

SEQ ID NO: 43355 - protein, 295 aa, Homo sapiens
MSEDPRGPKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQL

SEQ ID NO: 43356 - protein, 1041 aa, Homo sapiens; identical to SEQ ID NO: 43351

SEQ ID NO: 43357 - protein, 1041 aa, Homo sapiens; identical to SEQ ID NO: 43351

SEQ ID NO: 43358 - protein, 1041 aa, Homo sapiens; identical to SEQ ID NO: 43351

SEQ ID NO: 43359 - protein, 295 aa, Homo sapiens; identical to SEQ ID NO: 43355

SEQ ID NO: 43360 - protein, 295 aa, Homo sapiens; identical to SEQ ID NO: 43355

SEQ ID NO: 43361 - protein, 560 aa, Homo sapiens; identical to SEQ ID NO: 43350

SEQ ID NO: 43362 - protein, 295 aa, Homo sapiens; identical to SEQ ID NO: 43355

SEQ ID NO: 43363 - protein, 295 aa, Homo sapiens; identical to SEQ ID NO: 43355

SEQ ID NO: 43364 - protein, 295 aa, Homo sapiens; identical to SEQ ID NO: 43355

SEQ ID NO: 43365 - protein, 295 aa, Homo sapiens; identical to SEQ ID NO: 43355

SEQ ID NO: 43366 - protein, 560 aa, Homo sapiens; identical to SEQ ID NO: 43350

SEQ ID NO: 43367 - protein, 295 aa, Homo sapiens; identical to SEQ ID NO: 43355

SEQ ID NO: 43368 - protein, 669 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARK

SEQ ID NO: 43369 - protein, 1041 aa, Homo sapiens; identical to SEQ ID NO: 43351

SEQ ID NO: 43370 - protein, 560 aa, Homo sapiens; identical to SEQ ID NO: 43350

SEQ ID NO: 43371 - protein, 560 aa, Homo sapiens; identical to SEQ ID NO: 43350

SEQ ID NO: 43372 - protein, 188 aa, Homo sapiens
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARK

SEQ ID NO: 43373 - protein, 1041 aa, Homo sapiens; identical to SEQ ID NO: 43351

SEQ ID NO: 43374 - protein, 147 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKK

SEQ ID NO: 43375 - protein, 1369 aa, Homo sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 43376 - protein, 662 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQVYNPRIRANSLVMQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 43377 - protein, 743 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQDIEKVCETVYQGSNLNPDLGELVVVPLYPKEKCSLFKPLDETEKRCQVYQRRVVLTTSSGEFLIWSNSVRFVIDVGVERRKVYNPRIRANSLVMQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 43378 - protein, 367 aa, Homo sapiens
MQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 43379 - protein, 112 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGG

SEQ ID NO: 43380 - protein, 707 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 43381 - protein, 483 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGSPFFTGHPGVPHWAGGDRSHEQDVPRHCKAPPRRLPCDAGPSSVRLPALCTAAPSLPRGPKDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 43382 - protein, 979 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 43383 - protein, 994 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 43384 - protein, 1008 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 43385 - protein, 994 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSGTMSQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 43386 - protein, 1227 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 43387 - protein, 539 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 43388 - protein, 779 aa, Homo sapiens
MSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 43389 - protein, 722 aa, Homo sapiens
MSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVSKIKLFQ

SEQ ID NO: 43390 - protein, 731 aa, Homo sapiens
MIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTVSQTSLTFVTHIQIMKQISENQHSLTGLTIAGITGVSHHARPRNMTCNEKLNQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 43391 - protein, 702 aa, Homo sapiens
MSRFPAVAGRAPRRQEEGERSRDLQEERLSAVCIADREEKGCTSQEGGTTPTFPIQKQRKKIIQAETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 43392 - protein, 1220 aa, Homo sapiens [sequence omitted]

SEQ ID NO: 43393 - protein, 1181 aa, Homo sapiens
MAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPECPKHFLPVVAVAVSLEQCLSKFEDLNKELGLVTC

SEQ ID NO: 43394 - protein, 1270 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 43395 - protein, 599 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKKKK

SEQ ID NO: 43396 - protein, 398 aa, Homo sapiens
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 43397 - protein, 398 aa, Homo sapiens; identical to SEQ ID NO: 43396

SEQ ID NO: 43398 - protein, 364 aa, Homo sapiens
MMLKGITRLISRIHKLDPGRFLHMGTQARQSIAAHLDNQVPVESPRAISRTNENDPVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 43399 - protein, 357 aa, Homo sapiens
MMLKGITRLISRIHKAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 43400 - protein, 348 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCGEEVQGFQRWSRLEGEYKELLGHWAVYAIQYIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 43401 - protein, 318 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 43402 - protein, 348 aa, Homo sapiens; identical to SEQ ID NO: 43400

SEQ ID NO: 43403 - protein, 318 aa, Homo sapiens; identical to SEQ ID NO: 43401

SEQ ID NO: 43404 - protein, 275 aa, Homo sapiens
MAGLKRRASQVWPEEHGEQEHGLYSLHRMFDIVGTHLTHRDVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 43405 - protein, 318 aa, Homo sapiens; identical to SEQ ID NO: 43401

SEQ ID NO: 43406 - protein, 318 aa, Homo sapiens; identical to SEQ ID NO: 43401

SEQ ID NO: 43407 - protein, 102 aa, Homo sapiens
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRK

SEQ ID NO: 43408 - protein, 370 aa, Homo sapiens
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 43409 - protein, 370 aa, Homo sapiens; identical to SEQ ID NO: 43408

SEQ ID NO: 43410 - protein, 81 aa, Homo sapiens
MFQASMRSPNMEPFKQQKVEDFYDIGEELGSGQFAIVKKCREKSTGLEYAAKFIKKRQSRASRRGVSREEIEREVSILRQV

SEQ ID NO: 43411 - protein, 740 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 43412 - protein, 740 aa, Homo sapiens; identical to SEQ ID NO: 43411

SEQ ID NO: 43413 - protein, 740 aa, Homo sapiens; identical to SEQ ID NO: 43411

SEQ ID NO: 43414 - protein, 740 aa, Homo sapiens; identical to SEQ ID NO: 43411

SEQ ID NO: 43415 - protein, 130 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINEL

SEQ ID NO: 43416 - protein, 48 aa, Homo sapiens
MATANSIIVLDDDDEDEAAAQPGPSHPLPNAASPGAEAPSSSEPHGAR

SEQ ID NO: 43417 - protein, 130 aa, Homo sapiens; identical to SEQ ID NO: 43415

SEQ ID NO: 43418 - protein, 48 aa, Homo sapiens; identical to SEQ ID NO: 43416

SEQ ID NO: 43419 - protein, 178 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQS

SEQ ID NO: 43420 - protein, 178 aa, Homo sapiens; identical to SEQ ID NO: 43419

SEQ ID NO: 43421 - protein, 740 aa, Homo sapiens; identical to SEQ ID NO: 43411

SEQ ID NO: 43422 - protein, 740 aa, Homo sapiens; identical to SEQ ID NO: 43411

SEQ ID NO: 43423 - protein, 130 aa, Homo sapiens; identical to SEQ ID NO: 43415

SEQ ID NO: 43424 - protein, 178 aa, Homo sapiens; identical to SEQ ID NO: 43419

SEQ ID NO: 43425 - protein, 740 aa, Homo sapiens; identical to SEQ ID NO: 43411

SEQ ID NO: 43426 - protein, 48 aa, Homo sapiens; identical to SEQ ID NO: 43416

SEQ ID NO: 43427 - protein, 130 aa, Homo sapiens; identical to SEQ ID NO: 43415

SEQ ID NO: 43428 - protein, 178 aa, Homo sapiens; identical to SEQ ID NO: 43419

SEQ ID NO: 43429 - protein, 740 aa, Homo sapiens; identical to SEQ ID NO: 43411

SEQ ID NO: 43430 - protein, 48 aa, Homo sapiens; identical to SEQ ID NO: 43416

SEQ ID NO: 43431 - protein, 665 aa, Homo sapiens
MQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 43432 - protein, 665 aa, Homo sapiens; identical to SEQ ID NO: 43431

SEQ ID NO: 43433 - protein, 665 aa, Homo sapiens; identical to SEQ ID NO: 43431

SEQ ID NO: 43434 - protein, 665 aa, Homo sapiens; identical to SEQ ID NO: 43431

SEQ ID NO: 43435 - protein, 359 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 43436 - protein, 250 aa, Homo sapiens
MKATIILLLLAQVSWAGPFQQRGLFDFMLEDEASGIGPEVPDDRDFEPSLGPVCPFRCQCHLRVVQCSDLELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 43437 - protein, 172 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHVVYLHNNNISVVGSSDFCPPGHNTKKASYSGVSLFSNPVQYWEIQPSTFRCVYVRSAIQLGNYK

SEQ ID NO: 43438 - protein, 359 aa, Homo sapiens; identical to SEQ ID NO: 43435

SEQ ID NO: 43439 - protein, 250 aa, Homo sapiens; identical to SEQ ID NO: 43436

SEQ ID NO: 43440 - protein, 212 aa, Homo sapiens
MKATIILLLLAQVSWAGPFQQRGLFDFMLEDEASGIGPEVPDDRDFEPSLGPVCPFRCQCHLRVVQCSDLGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 43441 - protein, 172 aa, Homo sapiens; identical to SEQ ID NO: 43437

SEQ ID NO: 43442 - protein, 75 aa, Homo sapiens
MKATIILLLLAQVSWAGPFQQRGLFDFMLEDEASGIGPEVPDDRDFEPSLGPVCPFRCQCHLRVVQCSDLGCLPS

SEQ ID NO: 43443 - protein, 212 aa, Homo sapiens; identical to SEQ ID NO: 43440

SEQ ID NO: 43444 - protein, 179 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVI

SEQ ID NO: 43445 - protein, 119 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISK

SEQ ID NO: 43446 - protein, 174 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLN

SEQ ID NO: 43447 - protein, 178 aa, Homo sapiens
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIV

SEQ ID NO: 43448 - protein, 359 aa, Homo sapiens; identical to SEQ ID NO: 43435

SEQ ID NO: 43449 - protein, 1865 aa, Homo sapiens
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQASVDSGIVQ

SEQ ID NO: 43450 - protein, 2186 aa, Homo sapiens
MAGERTRRFTRSLLRPGQAAELRHSAASAAAVAVSSRQQQRQEKPRLLEPLDYETVIEELEKTYRNDPLQDLLFFPSDDFSAATVSWDIRTLYSTVPEDAEHKAENLLVKEACKFYSSQWHVVNYKYEQYSGDIRQLPRAEYKPEKLPSHSFEIDHEDADKDEDTTSHSSSKGGGGAGGTGVFKSGWLYKGNFNSTVNNTVTVRSFKKRYFQLTQLPDNSYIMNFYKDEKISKEPKGCIFLDSCTGVVQNNRLRKYAFELKMNDLTYFVLAAETESDMDEWIHTLNRILQISPEGPLQGRRSTELTDLGLDSLDNSVTCECTPEETDSSENNLHADFAKYLTETEDTVKTTRNMERLNLFSLDPDIDTLKLQKKDLLEPESVIKPFEEKAAKRIMIICKALNSNLQGCVTENENDPITNIEPFFVSVALYDLRDSRKISADFHVDLNHAAVRQMLLGASVALENGNIDTITPRQSEEPHIKGLPEEWLKFPKQAVFSVSNPHSEIVLVAKIEKVLMGNIASGAEPYIKNPDSNKYAQKILKSNRQFCSKLGKYRMPFAWAVRSVFKDNQGNVDRDSRFSPLFRQESSKISTEDLVKLVSDYRRADRISKMQTIPGSLDIAVDNVPLEHPNCVTSSFIPVKPFNMMAQTEPTVEVEEFVYDSTKYCRPYRVYKNQIYIYPKHLKYDSQKCFNKARNITVCIEFKNSDEESAKPLKCIYGKPGGPLFTSAAYTAVLHHSQNPDFSDEVKIELPTQLHEKHHILFSFYHVTCDINAKANAKKKEALETSVGYAWLPLMKHDQIASQEYNIPIATSLPPNYLSFQDSASGKHGGSDIKWVDGGKPLFKVSTFVVSTVNTQDPHVNAFFQECQKREKDMSQSPTSNFIRSCKNLLNVEKIHAIMSFLPIILNQLFKVLVQNEEDEITTTVTRVLTDIVAKCHEEQLDHSVQSYIKFVFKTRACKERTVHEELAKNVTGLLKSNDSTTVKHVLKHSWFFFAIILKSMAQHLIDTNKIQLPRPQRFPESYQNELDNLVMVLSDHVIWKYKDALEETRRANHSVARFLKRCFTFMDRGYVFKMVNNYISMFSSGDLKTLCQYKFDFLQEVCQHEHFIPLCLPIRSANIPDPLTPSESTQELHASDMPEYSVTNEFCRKHFLIGILLREVGFALQEDQDVRHLALAVLKNLMAKHSFDDRYREPRKQAQIASLYMPLYGMLLDNMPRIYLKDLYPFTVNTSNQGSRDDLSTNGGFQSQTAIKHANSVDTSFSKDVLNSIAAFSSIAISTVNHADSRASLASLDSNPSTNEKSSEKTDNCEKIPRPLSLIGSTLRFDKLDQAETRSLLMCFLHIMKTISYETLIAYWQRAPSPEVSDFFSILDVCLQNFRYLGKRNIIRKIAAAFKFVQSTQNNGTLKGSNPSCQTSGLLSQWMHSTSSHEGHKQHRSQTLPIIRGKNALSNPKLLQMLDNTMTSNSNEIDIVHHVDTEANIATEVCLTILDLLSLFTQTHQRQLQQCDCQNSLMKRVFDTYMLFFQVNQSATALKHVFASLRLFVCKFPSAFFQGPADLCGSFCYEVLKCCNHRSRSTQTEASALLYFFMRKNFEFNKQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGYWKVEKICTASLLSEDTHPCDSNSLLTTPSGGSMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 43451 - protein, 700 aa, Homo sapiens
MTSNSNEIDIVHHVDTEANIATEVCLTILDLLSLFTQTHQRQLQQCDCQNSLMKRVFDTYMLFFQVNQSATALKHVFASLRLFVCKFPSAFFQGPADLCGSFCYEVLKCCNHRSRSTQTEASALLYFFMRKNFEFNKQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGVGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQLCRGPCLYSFCSSVSSISLSTVSKSDYGQGRPVKARSGPNLHSSN

SEQ ID NO: 43452 - protein, 2180 aa, Homo sapiens
MSFRGKVFKREPSEFWKKRRTVRRVNQEEIHRFSSQEKPRLLEPLDYETVIEELEKTYRNDPLQDLLFFPSDDFSAATVSWDIRTLYSTVPEDAEHKAENLLVKEACKFYSSQWHVVNYKYEQYSGDIRQLPRAEYKPEKLPSHSFEIDHEDADKDEDTTSHSSSKGGGGAGGTGVFKSGWLYKGNFNSTVNNTVTVRSFKKRYFQLTQLPDNSYIMNFYKDEKISKEPKGCIFLDSCTGVVQNNRLRKYAFELKMNDLTYFVLAAETESDMDEWIHTLNRILQISPEGPLQGRRSTELTDLGLDSLDNSVTCECTPEETDSSENNLHADFAKYLTETEDTVKTTRNMERLNLFSLDPDIDTLKLQKKDLLEPESVIKPFEEKAAKRIMIICKALNSNLQGCVTENENDPITNIEPFFVSVALYDLRDSRKISADFHVDLNHAAVRQMLLGASVALENGNIDTITPRQSEEPHIKGLPEEWLKFPKQAVFSVSNPHSEIVLVAKIEKVLMGNIASGAEPYIKNPDSNKYAQKILKSNRQFCSKLGKYRMPFAWAVRSVFKDNQGNVDRDSRFSPLFRQESSKISTEDLVKLVSDYRRADRISKMQTIPGSLDIAVDNVPLEHPNCVTSSFIPVKPFNMMAQTEPTVEVEEFVYDSTKYCRPYRVYKNQIYIYPKHLKYDSQKCFNKARNITVCIEFKNSDEESAKPLKCIYGKPGGPLFTSAAYTAVLHHSQNPDFSDEVKIELPTQLHEKHHILFSFYHVTCDINAKANAKKKEALETSVGYAWLPLMKHDQIASQEYNIPIATSLPPNYLSFQDSASGKHGGSDIKWVDGGKPLFKVSTFVVSTVNTQDPHVNAFFQECQKREKDMSQSPTSNFIRSCKNLLNVEKIHAIMSFLPIILNQLFKVLVQNEEDEITTTVTRVLTDIVAKCHEEQLDHSVQSYIKFVFKTRACKERTVHEELAKNVTGLLKSNDSTTVKHVLKHSWFFFAIILKSMAQHLIDTNKIQLPRPQRFPESYQNELDNLVMVLSDHVIWKYKDALEETRRANHSVARFLKRCFTFMDRGYVFKMVNNYISMFSSGDLKTLCQYKFDFLQEVCQHEHFIPLCLPIRSANIPDPLTPSESTQELHASDMPEYSVTNEFCRKHFLIGILLREVGFALQEDQDVRHLALAVLKNLMAKHSFDDRYREPRKQAQIASLYMPLYGMLLDNMPRIYLKDLYPFTVNTSNQGSRDDLSTNGGFQSQTAIKHANSVDTSFSKDVLNSIAAFSSIAISTVNHADSRASLASLDSNPSTNEKSSEKTDNCEKIPRPLSLIGSTLRFDKLDQAETRSLLMCFLHIMKTISYETLIAYWQRAPSPEVSDFFSILDVCLQNFRYLGKRNIIRKIAAAFKFVQSTQNNGTLKGSNPSCQTSGLLSQWMHSTSSHEGHKQHRSQTLPIIRGKNALSNPKLLQMLDNTMTSNSNEIDIVHHVDTEANIATEVCLTILDLLSLFTQTHQRQLQQCDCQNSLMKRVFDTYMLFFQVNQSATALKHVFASLRLFVCKFPSAFFQGPADLCGSFCYEVLKCCNHRSRSTQTEASALLYFFMRKNFEFNKQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGYWKVEKICTASLLSEDTHPCDSNSLLTTPSGGSMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 43453 - protein, 1830 aa, Homo sapiens
MAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 43454 - protein, 336 aa, Homo sapiens
MCVCAEDGKTLPVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILIGACCNCGFPSSTPHSLIQWLWG

SEQ ID NO: 43455 - protein, 891 aa, Homo sapiens
MTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 43456 - protein, 2030 aa, Homo sapiens
MWTPTEEEKYGVVICSFRGSVPQGLVLEIGETVQILEKCEGWYRGVSTKKPNVKGIFPANYIHLKKAIVSNRGQYETVVPLEDSIVTEVTATLQEWASLWKQLYVKHKVDLFYKLRHVMNELIDLRRQLLSGHLTQDQVREVKRHITVRLDWGNEHLGLDLVPRKDFEVVDSDQISVSDLYKMHLSSRQSVQQSTSQVDTMRPRHGETCRMPVPHHFFLSLKSFTYNTIGEDTDVFFSLYDMREGKQISERFLVRLNKNGGPRNPEKIERMCALFTDLSSKDMKRDLYIVAHVIRIGRMLLNDSKKGPPHLHYRRPYGCAVLSILDVLQSLTEVKEEKDFVLKVYTCNNESEWSQIHENIIRKSSAKYSAPSASHGLIISLQLLRGDMEQIRRENPMIFNRGLAITRKLGFPDVIMPGDIRNDLYLTLEKGDFERGGKSVQKNIEVTMYVLYADGEILKDCISLGSGEPNRSSYHSFVLYHSNSPRWGEIIKLPIPIDRFRGSHLRFEFRHCSTKDKGEKKLFGFAFSTLMRDDGTTLSDDIHELYVYKCDENSTFNNHALYLGLPCCKEDYNGCPNIPSSLIFQRSTKESFFISTQLSSTKLTQNVDLLALLKWKAFPDRIMDVLGRLRHVSGEEIVKFLQDILDTLFVILDDNTEKYGLLVFQSLVFIINLLRDIKYFHFRPVMDTYIQKHFAGALAYKELIRCLKWYMDCSAELIRQDHIQEAMRALEYLFKFIVQSRILYSRATCGMEEEQFRSSIQELFQSIRFVLSLDSRNSETLLFTQAALLNSFPTIFDELLQMFTVQEVAEFVRGTLGSMPSTVHIGQSMDVVKLQSIARTVDSRLFSFSESRRILLPVVLHHIHLHLRQQKELLICSGILGSIFSIVKTSSLEADVMEEVEMMVESLLDVLLQTLLTIMSKSHAQEAVRGQRCPQCTAEITGEYVSCLLSLLRQMCDTHFQHLLDNFQSKDELKEFLLKIFCVFRNLMKMSVFPRDWMVMRLLTSNIIVTTVQYLSSALHKNFTETDFDFKVWNSYFSLAVLFINQPSLQLEIITSAKRKKILDKYGDMRVMMAYELFSMWQNLGEHKIHFIPGMIGPFLGVTLVPQPEVRNIMIPIFHDMMDWEQRKNGNFKQVEAELIDKLDSMVSEGKGDESYRELFSLLTQLFGPYPSLLEKVEQETWRETGISFVTSVTRLMERLLDYRDCMKGEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSPMNLMGTGRHSSSSLSSHASSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKGHYSLHFDAFHHPLGDTPPALPARTLRKSPLHPIPASPTSPQSGLDGSNSTLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 43457 - protein, 594 aa, Homo sapiens
MPKWLEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSPMNLMGTGRHSSSSLSSHASSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAA

SEQ ID NO: 43458 - protein, 1925 aa, Homo sapiens
VIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 43459 - protein, 1954 aa, Homo sapiens
VIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 43460 - protein, 1975 aa, Homo sapiens
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 43461 - protein, 1966 aa, Homo sapiens
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 43462 - protein, 849 aa, Homo sapiens
MKMHSTERIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 43463 - protein, 1105 aa, Homo sapiens
WIPSEKQTFFTVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALRQENRLNLGGGGCSEPRACHCTPAWATKRDCVSKKKEKKT

SEQ ID NO: 43464 - protein, 2047 aa, Homo sapiens
MAASERRAFAHKINRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 43465 - protein, 1386 aa, Homo sapiens [sequence omitted]

SEQ ID NO: 43466 - protein, 1990 aa, Homo sapiens
MATLPSAERRAFALKINRYSSAEIRKQFTLPPNLGQYHRQSISTSGFPSLQLPQFYDPVEPVDFEGLLMTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIM

SEQ ID NO: 43467 - protein, 2031 aa, Homo sapiens
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 43468 - protein, 2099 aa, Homo sapiens
MATLPSAERRAFALKINRYSSAEIRKQFTLPPNLGQYHRQSISTSGFPSLQLPQFYDPVEPVDFEGLLMTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 43469 - protein, 1999 aa, Homo sapiens
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 43470 - protein, 393 aa, Homo sapiens
MKRTRDEVDATLQIAKLNAAELLPAVHCLGFGPGASGAAAGDFCLLELEPTLCQQLEDGHSLVIRGDKDEQAVLCSKDKTYDLKIADTSNMLLFIPGCKTPDQLKKEDSHCNIIHTEIFGFSNNYWELRRRRPKLKKLKKLLMENPYEGPDSQKEKDSNSSKYTTEDLLDQIQASEEEIMTQLQVLNACKIGGYWRILEFDYEMKLLNHVTQLVDSESWSFGKVPLNTCLQELGPLEPEEMIEHCLKCYGKKYVDEGEVYFELDADKICRAAARMLLQNAVKFNLAEFQEVWQQSVPEGMVTSLDQLKGLALVDRHSRPEIIFLLKVDDLPEDNQERFNSLFSLREKWTEEDIAPYIQDLCGEKQTIGALLTKYSHSSMQNGVKVYNSRRPIS

SEQ ID NO: 43471 - protein, 113 aa, Homo sapiens
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 43472 - protein, 94 aa, Homo sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 43473 - protein, 94 aa, Homo sapiens; identical to SEQ ID NO: 43472

SEQ ID NO: 43474 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 43475 - protein, 94 aa, Homo sapiens
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 43476 - protein, 100 aa, Homo sapiens
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 43477 - protein, 68 aa, Homo sapiens
MRTSYLLLFTLCLLLSEMASGGNFLTGLGHRSDHYNCVSSGGQCLYSACPIFTKIQGTCYRGKAKCCK

SEQ ID NO: 43478 - protein, 123 aa, Homo sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 43479 - protein, 333 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 43480 - protein, 334 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQQKARDMYAEERKRQQLERDQATVTEQLLREGLQASGDAQLRRTRLHKLSARREERVQGFLQALELKRADWLARLGTASA

SEQ ID NO: 43481 - protein, 171 aa, Homo sapiens
MDLARQKFSRLMEEKEKLQKHGVCIRVLGDLHLLPLDLQELIAQAVQATKNYNNDISESLLDKCLYTNRSPHPDILIRTSGEVRLSDFLLWQQKARDMYAEERKRQQLERDQATVTEQLLREGLQASGDAQLRRTRLHKLSARREERVQGFLQALELKRADWLARLGTASA

SEQ ID NO: 43482 - protein, 166 aa, Homo sapiens
MDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSRDRFHHIGQASLELLTS

SEQ ID NO: 43483 - protein, 181 aa, Homo sapiens
MEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQHPGSLLTKAWKKPFQQDGELYGNCSSPKSS

SEQ ID NO: 43484 - protein, 222 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPRYPDDISESLLDKCLYTNRSPHPDILIRTSGEVRLSDFLLWQ

SEQ ID NO: 43485 - protein, 122 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLG

SEQ ID NO: 43486 - protein, 71 aa, Homo sapiens
MSWIKEGELSLWERFCANIIKAGPMPKHIAFIMDGNRRYAKKCQVERQEGHSQGFNKLAETLRWCLNLGIL

SEQ ID NO: 43487 - protein, 85 aa, Homo sapiens
MSWIKEGELSLWERFCANIIKAGPMPKHIAFIMDGNRRYAKKCQVERQEGHSQGFNKLAETLRWCLNLGILEVTVYAFSIENFKR

SEQ ID NO: 43488 - protein, 294 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 43489 - protein, 60 aa, Homo sapiens
MSWIKEGELSLWERFCANIIKAGPMPKHIAFIMDGNRRYAKKCQVERQEGHSQGFNKLAE

SEQ ID NO: 43490 - protein, 131 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDL

SEQ ID NO: 43491 - protein, 166 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAV

SEQ ID NO: 43492 - protein, 302 aa, Homo sapiens
MVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 43493 - protein, 147 aa, Homo sapiens
MGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRV

SEQ ID NO: 43494 - protein, 140 aa, Homo sapiens
MASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 43495 - protein, 278 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 43496 - protein, 170 aa, Homo sapiens
MASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKRRLSGDRVFHSSLQSISSLDGQGKRGKHERNPADKKVRRARGLCWHRVFPVL

SEQ ID NO: 43497 - protein, 181 aa, Homo sapiens
MASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPLWMDKEKEESMKETLRIRRLGEPEDCAGIVSFLCSEDASYITGETVVVGGGTPSRL

SEQ ID NO: 43498 - protein, 158 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 43499 - protein, 192 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRRLGEPEDCAGIVSFLCSEDASYITGETVVVGGGTPSRL

SEQ ID NO: 43500 - protein, 226 aa, Homo sapiens
MASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 43501 - protein, 188 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKRRLSGDRVFHSSLQSISSLDGQGKRGKHERNPADKKVRRARGLCWHRVFPVL

SEQ ID NO: 43502 - protein, 199 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPLWMDKEKEESMKETLRIRRLGEPEDCAGIVSFLCSEDASYITGETVVVGGGTPSRL

SEQ ID NO: 43503 - protein, 339 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 43504 - protein, 375 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITRWGRKGLRTLRVVWMQTLLILKSLRQNMTEKSTCTFQATGGRNGKHENSNLLMLLNNQRLICDFTF

SEQ ID NO: 43505 - protein, 289 aa, Homo sapiens
MVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 43506 - protein, 339 aa, Homo sapiens; identical to SEQ ID NO: 43503

SEQ ID NO: 43507 - protein, 61 aa, Homo sapiens
MNWELLLWLLVLCALLLLLVQLLRFLRADGDLTLLWAEWQGRRPEWELTDMVVWVTGASSG

SEQ ID NO: 43508 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 43509 - protein, 319 aa, Homo sapiens; identical to SEQ ID NO: 43508

SEQ ID NO: 43510 - protein, 319 aa, Homo sapiens; identical to SEQ ID NO: 43508

SEQ ID NO: 43511 - protein, 172 aa, Homo sapiens
MLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 43512 - protein, 319 aa, Homo sapiens; identical to SEQ ID NO: 43508

SEQ ID NO: 43513 - protein, 379 aa, Homo sapiens
MPEGRSHCACSITSLTLLVSLTRVTLDILQKLDPPQPAHWRHHLLVLYKKGVYLSHTGGKMLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 43514 - protein, 319 aa, Homo sapiens; identical to SEQ ID NO: 43508

SEQ ID NO: 43515 - protein, 66 aa, Homo sapiens
MLFWVLGLLILCGFLWTRKGKLKIEDITDKYIFITGCDSGFGNLAARTFDKKGFHVIAACLTESGS

SEQ ID NO: 43516 - protein, 161 aa, Homo sapiens
  MOD_RES (126)..(126): Selenocysteine
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTCPSFMFKFDQFKRLIEDFSSIADFLVIYIEEAHASG

SEQ ID NO: 43517 - protein, 249 aa, Homo sapiens
  MOD_RES (126)..(126): Selenocysteine
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTCPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 43518 - protein, 201 aa, Homo sapiens
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 43519 - protein, 120 aa, Homo sapiens
MFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 43520 - protein, 185 aa, Homo sapiens
  MOD_RES (62)..(62): Selenocysteine
MGLPQPGLWLKRLWVLLEVAVHVVVGKVLLILFPDRVKRNILAMGEKTGNRPLVLNFGSCTCPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 43521 - protein, 113 aa, Homo sapiens
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQG

SEQ ID NO: 43522 - protein, 89 aa, Homo sapiens
MGILSVDLLITLQILPVFFSNCLFLALYDSVILLKHVVLLLSRSKSTRGEWRRMLTSEGLRCVWKSFLLDAYKQLNCPPSGFSKDGHIL

SEQ ID NO: 43523 - protein, 132 aa, Homo sapiens
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSAT

SEQ ID NO: 43524 - protein, 273 aa, Homo sapiens
  MOD_RES (133)..(133): Selenocysteine
  MOD_RES (266)..(266): Selenocysteine
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATCPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRCKKTRLAG

SEQ ID NO: 43525 - protein, 6 aa, Homo sapiens
MGILSV

SEQ ID NO: 43526 - protein, 6 aa, Homo sapiens
MGILSV

SEQ ID NO: 43527 - protein, 55 aa, Homo sapiens
MGILSVDLLITLQILPVFFSNCLFLALYDSVILLKHVVLLLSRSKSTRGEWRRML

SEQ ID NO: 43528 - protein, 309 aa, Homo sapiens
  MOD_RES (90)..(90): Selenocysteine
  MOD_RES (169)..(169): Selenocysteine
  MOD_RES (302)..(302): Selenocysteine
MGILSVDLLITLQILPVFFSNCLFLALYDSVILLKHVVLLLSRSKSTRGEWRRMLTSEGLRCVWKSFLLDAYKQLNCPPSGFSKDGHILCLVYEAYKSRLLVYSHLDLWMVKLGEDAPNSSVVHVSSTEGGDNSGNGTQEKIAEGATCHLLDFASPERPLVVNFGSATCPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRCKKTRLAG

SEQ ID NO: 43529 - protein, 273 aa, Homo sapiens; identical to SEQ ID NO: 43524
  MOD_RES (133)..(133): Selenocysteine
  MOD_RES (266)..(266): Selenocysteine

SEQ ID NO: 43530 - protein, 304 aa, Homo sapiens
  MOD_RES (170)..(170): Selenocysteine
MPRQATSRLVVGEGEGSQGASGPAATMLRSLLLHSLRLCAQTASCLVLFPRFLGTAFMLWLLDFLCIRKHFLGRRRRGQPEPEVELNSEGEEVPPDDPPICVSDDNRLCTLASLKAVWHGQKLDFFKQAHEGGPAPNSEVVLPDGFQSQHILDYAQGNRPLVLNFGSCTCPPFMARMSAFQRLVTKYQRDVDFLIIYIEEAHPSDGWVTTDSPYIIPQHRSLEDRVSAARVLQQGAPGCALVLDTMANSSSSAYGAYFERLYVIQSGTIMYQGGRGPDGYQVSELRTWLERYDEQLHGARPRRV

SEQ ID NO: 43531 - protein, 341 aa, Homo sapiens
MSASAPAAEGEGTPTQPASEKEPEMPGPREESEEEEDEDDEEEEEEEKGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 43532 - protein, 375 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 43533 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPSSPFQVTAGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43534 - protein, 534 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43535 - protein, 606 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43536 - protein, 486 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43537 - protein, 558 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43538 - protein, 361 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPFQVATGYQFPVYNYQAFPAYPNSPVQVTTGYQLPVYNYQMPP

SEQ ID NO: 43539 - protein, 654 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43540 - protein, 534 aa, Homo sapiens; identical to SEQ ID NO: 43534

SEQ ID NO: 43541 - protein, 438 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPFQVATGYQFPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43542 - protein, 390 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43543 - protein, 581 aa, Homo sapiens
MMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPFQVATGYQFPVYNYQAFPAYPNSPVQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 43544 - protein, 337 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQMPP

SEQ ID NO: 43545 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPVQVTTGYQLPVYNYQAFPAYPNSPVQVTTGYQLPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43546 - protein, 438 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43547 - protein, 361 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSPVQVTTGYQLPVYNYQMPP

SEQ ID NO: 43548 - protein, 390 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 43549 - protein, 315 aa, Homo sapiens
MAAPSCGGDRKARLTPSLPHESTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 43550 - protein, 295 aa, Homo sapiens
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 43551 - protein, 761 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 43552 - protein, 320 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSGRESHSVPLHEWP

SEQ ID NO: 43553 - protein, 761 aa, Homo sapiens; identical to SEQ ID NO: 43551

SEQ ID NO: 43554 - protein, 467 aa, Homo sapiens
MKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 43555 - protein, 1125 aa, Homo sapiens
MGDPKAHVMARPLRAPLRRSFSDHIRDSTARALDVIWKNTRDRRLAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 43556 - protein, 1017 aa, Homo sapiens
MKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 43557 - protein, 323 aa, Homo sapiens
MGNSASRSDFEWVYTDQPHTQRRKEILAKYPAIKALMRPDPRLKWAVLVLVLVQMLACWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 43558 - protein, 737 aa, Homo sapiens
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 43559 - protein, 455 aa, Homo sapiens
MLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 43560 - protein, 310 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 43561 - protein, 383 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 43562 - protein, 97 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPC

SEQ ID NO: 43563 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 43564 - protein, 587 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 43565 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 43566 - protein, 740 aa, Homo sapiens
MASHLRPPSPLLVRVYKSGPRVRRKLESYFQSSKSSGGGECTVSTQEHEAPGTFRVEFSERAAKERVLKKGEHQILVDEKPVPIFLVPTENSIKKNTRPQISSLTQSQAETPSGDMHQHEGHIPNAVDSCLQKIFLTVTADLNCNLFSKEQRAYITTLCPSIRKMEGHDGIEKVCGDFQDIERIHQFLSEQFLESEQKQQFSPSMTERKPLSQQERDSCISPSEPETKAEQKSNYFEVPLPYFEYFKYICPDKINSIEKRFGVNIEIQESSPNMVCLDFTSSRSGDLEAARESFASEFQKNTEPLKQECVSLADSKQANKFKQELNHQFTKLLIKEKGGELTLLGTQDDISAAKQKISEAFVKIPVKLFAANYMMNVIEVDSAHYKLLETELLQEISEIEKRYDICSKVSEKGQKTCILFESKDRQVDLSVHAYASFIDAFQHASCQLMREVLLLKSLGKERKHLHQTKFADDFRKRHPNVHFVLNQESMTLTGLPNHLAKAKQYVLKGGGMSSLAGKKLKEGHETPMDIDSDDSKAASPPLKGSVSSEASELDKKEKGICVICMDTISNKKVLPKCKHEFCAPCINKAMSYKPICPTCQTSYGIQKGNQPEGSMVFTVSRDSLPGYESFGTIVITYSMKAGIQTEEHPNPGKRYPGIQRTAYLPDNKEGRKVLKLLYRAFDQKLIFTVGYSRVLGVSDVITWNDIHHKTSRFGGPEMYGYPDPSYLKRVKEELKAKGIE

SEQ ID NO: 43567 - protein, 620 aa, Homo sapiens
MSRPGHGGLMPVNGLGFPPQNVARVVVWEWLNEHSRWRPYTATVCHHIENVLKEDARGSVVLGQVDAQLVPYIIDLQSMHQFRQDTGTMRPVRRNFYDPSSAPGKGIVWEWENDGGAWTAYDMDICITIQNAYEKQHPWLDLSSLGFCYLIYFNSMSQMNRQTRRRRRLRRRLDLAYPLTVGSIPKSQSWPVGASSGQPCSCQQCLLVNSTRAASNAILASQRRKAPPAPPLPPPPPPGGPPGALAVRPSATFTGAALWAAPAAGPAEPAPPPGAPPRSPGAPGGARTPGQNNLNRPGPQRTTSVSARASIPPGVPALPVKNLNGTGPVHPALAGMTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAAKA

SEQ ID NO: 43568 - protein, 347 aa, Homo sapiens
MSFVLSRMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 43569 - protein, 347 aa, Homo sapiens; identical to SEQ ID NO: 43568

SEQ ID NO: 43570 - protein, 347 aa, Homo sapiens; identical to SEQ ID NO: 43568

SEQ ID NO: 43571 - protein, 204 aa, Homo sapiens
MPILSSSGSKMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPM

SEQ ID NO: 43572 - protein, 7 aa, Homo sapiens
MPILSSS

SEQ ID NO: 43573 - protein, 350 aa, Homo sapiens
MPILSSSGSKMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 43574 - protein, 49 aa, Homo sapiens
MSFVLSRMAACGGTCKNKVTVSKPVWDFLSKETPARLARLREEHRVSIL

SEQ ID NO: 43575 - protein, 711 aa, Homo sapiens
MLDGPLFSEGPDSPRELQDEESGSCLWVQKSKLLVIEVKTISCHYSRRAPSRQPMDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVISQTEEVLFGVRDIRGTQQGNRKRQ

SEQ ID NO: 43576 - protein, 283 aa, Homo sapiens
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKFISGFQS

SEQ ID NO: 43577 - protein, 466 aa, Homo sapiens
MLKWPIPGQVALFQILRCRGNSRRTTVTSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQAL

SEQ ID NO: 43578 - protein, 559 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 43579 - protein, 1009 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 43580 - protein, 529 aa, Homo sapiens
MLKWPIPGQVALFQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 43581 - protein, 1020 aa, Homo sapiens
MRRPGDHGLQDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEHLVKPLRHYAVFLSEDSSDDECQREEGPSSGFTESFFFSAPFEWPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 43582 - protein, 794 aa, Homo sapiens
MLYPMYWQHVYIPVLPPHLLDYCCAPMPYLIGIHLSLMEKVRNMALDDVVILNVDTNTLETPFDDLQSLPNDVEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEHLVKPLRHYAVFLSEDSSDDECQREEGPSSGFTESFFFSAPFEWPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 43583 - protein, 396 aa, Homo sapiens
MAAAPREEKRWPQPVFSNPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGKDKLQYDYPFSQ

SEQ ID NO: 43584 - protein, 426 aa, Homo sapiens
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGKDKLQYDYPFSQ

SEQ ID NO: 43585 - protein, 396 aa, Homo sapiens; identical to SEQ ID NO: 43583

SEQ ID NO: 43586 - protein, 755 aa, Homo sapiens
IETKTRANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 43587 - protein, 775 aa, Homo sapiens
IETKTRANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 43588 - protein, 415 aa, Homo sapiens
VKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 43589 - protein, 801 aa, Homo sapiens
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASSGALRSYQLWADNLKKGGGALLHSVKAKTQPAVKNMYRSAKSGLKGVQSLLMYKDGDSVLQRGGSLRAPALPSRSDRLQQRLPITQHFGKNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 43590 - protein, 757 aa, Homo sapiens
MQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASSGALRSYQLWADNLKKGGGALLHSVKAKTQPAVKNMYRSAKSGLKGVQSLLMYKDGDSVLQRGGSLRAPALPSRSDRLQQRLPITQHFGKNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 43591 - protein, 730 aa, Homo sapiens
MLFNSVLRQPQLGVLRNGWSSQYPLQSLLTGYQCSGNDEHTSYGETGVPVPPFGCTFSSAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 43592 - protein, 409 aa, Homo sapiens
MLFNSVLRQPQLGVLRNGWSSQYPLQSLLTGYQCSGNDEHTSYGETGVPVPPFGCTFSSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 43593 - protein, 688 aa, Homo sapiens
MLFNSVLRQPQLGVLRNAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 43594 - protein, 497 aa, Homo sapiens
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 43595 - protein, 513 aa, Homo sapiens
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 43596 - protein, 1301 aa, Homo sapiens
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSNSSDSSDSSDSSDSSDSSDSSDSSDSSNSSDSSDSSDSSDSSDSSDSSDSSDSSESSDSSDSSNSSDSSDSSDSSDSSDSSDSSDSSDSSDSSNSSDSSDSSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 43597 - protein, 1301 aa, Homo sapiens; identical to SEQ ID NO: 43596

SEQ ID NO: 43598 - protein, 260 aa, Homo sapiens [sequence omitted]

SEQ ID NO: 43599 - protein, 15 aa, Homo sapiens
MATPPKRSCPSFSAS

SEQ ID NO: 43600 - protein, 277 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 43601 - protein, 239 aa, Homo sapiens
MAAGRLFLSRLRAPFSSMAKSPLEGVSSSRGLHAGRGPRRLSIEGNIACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 43602 - protein, 189 aa, Homo sapiens
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRLHFEALMNIPVLVLDVNDDFSEEVTKQEDLMREVNTFVKNL

SEQ ID NO: 43603 - protein, 255 aa, Homo sapiens
MAAGRLFLSRLRAPFSSMAKSPLEGVSSSRGLHAGRGPRRLSIEGNIGNILKQIRMRAPIQETACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 43604 - protein, 369 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 43605 - protein, 322 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEAQEFDGSDSGARPDEAVSWGKIRVDAQPVKVYADASLVFPLLVAETFAQKMDAFMHEKNED

SEQ ID NO: 43606 - protein, 327 aa, Homo sapiens
MPIIPAFWEAEAGGSREEEFETSLANMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 43607 - protein, 153 aa, Homo sapiens
MPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 43608 - protein, 361 aa, Homo sapiens
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 43609 - protein, 360 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 43610 - protein, 305 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 43611 - protein, 302 aa, Homo sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 43612 - protein, 302 aa, Homo sapiens; identical to SEQ ID NO: 43611

SEQ ID NO: 43613 - protein, 302 aa, Homo sapiens; identical to SEQ ID NO: 43611

SEQ ID NO: 43614 - protein, 302 aa, Homo sapiens; identical to SEQ ID NO: 43611

SEQ ID NO: 43615 - protein, 302 aa, Homo sapiens; identical to SEQ ID NO: 43611

SEQ ID NO: 43616 - protein, 302 aa, Homo sapiens; identical to SEQ ID NO: 43611

SEQ ID NO: 43617 - protein, 104 aa, Homo sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYR

SEQ ID NO: 43618 - protein, 26 aa, Homo sapiens
MHYPTALLFLILANGAQAFRICAFNA

SEQ ID NO: 43619 - protein, 208 aa, Homo sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHW

SEQ ID NO: 43620 - protein, 305 aa, Homo sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 43621 - protein, 305 aa, Homo sapiens; identical to SEQ ID NO: 43620

SEQ ID NO: 43622 - protein, 288 aa, Homo sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEVRLPSCLSMPLSWKDELAWAT

SEQ ID NO: 43623 - protein, 100 aa, Homo sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKE

SEQ ID NO: 43624 - protein, 275 aa, Homo sapiens
MSRELAPLLLLLLSIHSALAMRICSFNVRSFGESKQEDKNAMDVIVKVIKRCDIILVMEIKDSNNRICPILMEKLNREKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 43625 - protein, 250 aa, Homo sapiens
MTPLCPRPALCYHFLTSLLRSAMQNARTAEGRSRGTLRARPAPRPAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 43626 - protein, 252 aa, Homo sapiens
MTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 43627 - protein, 164 aa, Homo sapiens
MPCSEETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 43628 - protein, 141 aa, Homo sapiens
MQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 43629 - protein, 351 aa, Homo sapiens
MPLRKHRQHFKKYGNCFTAGEAVDWLYDLLRNNSNFGPEVTRQQTIQLLRKFLKNHVIEDIKGRWGSENVDDNNQLFRFPATSPLKTLPRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGNFKDFRSSIPVVCGYITVSDRSSGIHKIQDDPQSSKFLHLNNLNSFKSTECLLLSLLHREKNKEESDSTERLQISNPGFQERCAKKMQLVNLRNRRACCNLI

SEQ ID NO: 43630 - protein, 527 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 43631 - protein, 811 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 43632 - protein, 529 aa, Homo sapiens
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 43633 - protein, 467 aa, Homo sapiens
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQFQKSYPEVYQERFPTPESAALLFPEKPKPKPQLLMWALKKPFQPFQRTRSFRM

SEQ ID NO: 43634 - protein, 440 aa, Homo sapiens
MPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQFQKSYPEVYQERFPTPESAALLFPEKPKPKPQLLMWALKKPFQPFQRTRSFRM

SEQ ID NO: 43635 - protein, 1581 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43636 - protein, 1229 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQWPCSSPPPPGTQQEWTTSPASSASGLRWPLWQKSSCTLRFLPFSCPGCLAGQPPMQVGTAPLAEVLEDGARRQHF

SEQ ID NO: 43637 - protein, 1503 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVETSCFYLSIGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43638 - protein, 559 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTREHLG

SEQ ID NO: 43639 - protein, 1552 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSLGLYKINILPLLLTSLLRTSLSISTLQEQCFCSCPTPSASSQGSSGGGGTPPAPPTRTCSARSGSATTGPTTPCSPKHGAPAPQGMKSLLIGC

SEQ ID NO: 43640 - protein, 1572 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43641 - protein, 1572 aa, Homo sapiens; identical to SEQ ID NO: 43640

SEQ ID NO: 43642 - protein, 45 aa, Homo sapiens
MRTTKVYKLVIHKKGFGGSDDELVVNPKVFPHIKLGDIVEIAHPN

SEQ ID NO: 43643 - protein, 1503 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43644 - protein, 664 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGMNPRTQNKDSLEDSVSTSPDPSKRGQLTGERGRQGVWGGQSMRKQEEALWEVSGPEVHIPLGYGKAMW

SEQ ID NO: 43645 - protein, 420 aa, Homo sapiens
MKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43646 - protein, 1594 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 43647 - protein, 511 aa, Homo sapiens
MATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 43648 - protein, 502 aa, Homo sapiens
MRGLCEFYWQEFGIKGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 43649 - protein, 409 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 43650 - protein, 958 aa, Homo sapiens [sequence omitted]

SEQ ID NO: 43651 - protein, 958 aa, Homo sapiens [sequence omitted]

SEQ ID NO: 43652 - protein, 166 aa, Homo sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLY

SEQ ID NO: 43653 - protein, 958 aa, Homo sapiens [sequence omitted]

SEQ ID NO: 43654 - protein, 977 aa, Homo sapiens
MGSFEDGLAALEIWRSDATMRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLYNYLSKTQQEKFLEVIANASGYMYETSYRRGWGFQYLHNHQPTNCMALLTGSLVLMNQGYLQEAYLWTKQVLTIMEKSLVLLREVTDGSLYEGVAYGSYTTRSLFQYMFLVQRHFNINHFGHPWLKQHFAFMYRTILPGFQRTVAIADSNYNWFYGPESQLVFLDKFVMRNGSGNWLADQIRRNRVVEGPGTPSKGQRWCTLHTEFLWYDGSLKSVPPPDFGTPTLHYFEDWGVVTYGSALPAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 43655 - protein, 189 aa, Homo sapiens
MAALKGRQVYWATAGKISGWTWPHAPRRPHVLLLNGIGVGGALGSIDELLCQALSNGLNVPEGSLTSTCAQQPDGLIHTAKWGHVHSLSSHSPGAPNACGVLPGTTVDDGVHQDLQRVLACEQVYDLEGMLDDAHSHELLAVVAAVHHHGVSKALHNGTLSFVEAFGGIPPCTVRIFRRWFGCLGDLEI

SEQ ID NO: 43656 - protein, 1222 aa, Homo sapiens
MPKGGAPPWIMALMFTGHLLFLALLMFAFSTFEESVSNYSEWAVFTDDIDQFKTQKVQDFRPNQKLKKSMLHPSLYFDAGEIQAMRQKSRASHLHLFRAIRSAVTVMLSNPTYYLPPPKHADFAAKWNEIYGNNLPPLALYCLLCPEDKVAFEFVLEYMDRMVGYKDWLVENAPGDEVPIGHSLTGFATAFDFLYNLLDNHRRQKYLEKIWVITEEMYEYSKVRSWGKQLLHNHQATNMIALLTGALVTGVDKGSKANIWKQAVVDVMEKTMFLLNHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMEPTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 43657 - protein, 1212 aa, Homo sapiens
MALMFTGHLLFLALLMFAFSTFEESVSNYSEWAVFTDDIDQFKTQKVQDFRPNQKLKKSMLHPSLYFDAGEIQAMRQKSRASHLHLFRAIRSAVTVMLSNPTYYLPPPKHADFAAKWNEIYGNNLPPLALYCLLCPEDKVAFEFVLEYMDRMVGYKDWLVENAPGDEVPIGHSLTGFATAFDFLYNLLDNHRRQKYLEKIWVITEEMYEYSKVRSWGKQLLHNHQATNMIALLTGALVTGVDKGSKANIWKQAVVDVMEKTMFLLNHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMEPTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 43658 - protein, 201 aa, Homo sapiens
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 43659 - protein, 110 aa, Homo sapiens
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 43660 - protein, 396 aa, Homo sapiens
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 43661 - protein, 470 aa, Homo sapiens
MSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 43662 - protein, 840 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEESIRGHTLIKN

SEQ ID NO: 43663 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 43664 - protein, 896 aa, Homo sapiens
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 43665 - protein, 839 aa, Homo sapiens
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEESIRGHTG

SEQ ID NO: 43666 - protein, 1049 aa, Homo sapiens
MDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 43667 - protein, 1118 aa, Homo sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 43668 - protein, 1040 aa, Homo sapiens
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRDVSNICAPMTASNTQDRMDSSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 43669 - protein, 1059 aa, Homo sapiens
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRLFSAYALPGGGGTADGGGSVLGRCALQATPALLNQHPPFSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 43670 - protein, 165 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 43671 - protein, 148 aa, Homo sapiens
MKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 43672 - protein, 298 aa, Homo sapiens
MSDANLDSSKKNFLEGEVDDEESVILTLVPVKDDANMEQMEPSVSSTSDVKLEKPKKYNPGHLLQTNEQFTAPQKARCKIPALPLPTILPPINKVCRDTLRDWCQQLGLSTNGKKIEVYLRLHRHAYPEQRQDMPEMSQETRLQRCSRKRKAVTKRARLQRSYEMNERAEETNTVEVITSAPGAMLASWARIAARAVQPKALNSCSIPVSVEAFLMQASGVRWCVVHGRLLSADTKGWVRLQFHAGQAWVPTTHRRMISLFLLPACIFPSPGIEDNMLCPDCAKRNKKMMKRLMTVEK

SEQ ID NO: 43673 - protein, 159 aa, Homo sapiens
MDPSQFNPTYIPGSPQMLTEENSRDDSGASQISSETLIKNLSNLTINASSESVSPLSEALLRRESVGAAVLREIEDEWLYSRRGVRTLLSVQREKMARLRYMLLGGVRTHERRPTNKEPKGVKKESRPFKCPCSFCVSNGWDPSENARIGNQDTKPLQP

SEQ ID NO: 43674 - protein, 304 aa, Homo sapiens
MLRGSASSTSMEKAKGKEWTSTEKSREEDQQASNQPNSIALPGTSAKRTKEKMSIKGSKVLCPKKKAEHTDNPRPQKKIPIPPLPSKLPPVNLIHRDILRAWCQQLKLSSKGQKLDAYKRLCAFAYPNQKDFPSTAKEAKIRKSLQKKLKVEKGETSLQSSETHPPEVALPPVGEPPALENSTALLEGVNTVVVTTSAPEALLASWARISARARTPEAVESPQEASGVRWCVVHGKSLPADTDGWVHLQFHAGQAWVPEKQEGRVSALFLLPASNFPPPHLEDNMLCPKCVHRNKVLIKSLQWE

SEQ ID NO: 43675 - protein, 116 aa, Homo sapiens
MGTLPARRHIPPWVKVPEDLKDPEVFQVQTRLLKAIFGPDGSRIPYIEQVSKAMLELKALESSDLTEVVVYGSYLYKLRTKWMLQSMAEWHRQRQERGMLKLAEAMNALELGPWMK

SEQ ID NO: 43676 - protein, 367 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 43677 - protein, 364 aa, Homo sapiens
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 43678 - protein, 343 aa, Homo sapiens
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKAPAPSTVRSGWA

SEQ ID NO: 43679 - protein, 678 aa, Homo sapiens
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDALAALQDFYHREHVTKTQILCAERRLLALFDDRKNELAHLATHGPENPKLEMLEKILQRQFSSSNSPRGIIFTRTRQSAHSLLLWLQQQQGLQTVDIRAQLLIGAGNSSQSTHMTQRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKIRDLQQAALTKRAAQAAQRENQRQQFPVEHVQLLCINCMVAVGHGSDLRKVEGTHHVNVNPNFSNYYNVSRDPVVINKVFKDWKPGGVISCRNCGEVWGLQMIYKSVKLPVLKVRSMLLETPQGRIQAKKWSRVPFSVPDFDFLQHCAENLSDLSLD

SEQ ID NO: 43680 - protein, 302 aa, Homo sapiens
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDA

SEQ ID NO: 43681 - protein, 487 aa, Homo sapiens
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDALAALQDFYHREHVTKTQILCAERRLLALFDDRKNELAHLATHGPENPKLEMLEKILQRQFSSSNSPRGIIFTRTRQSAHSLLLWLQQQQGLQTVDIRAQLLIGAGNSSQSTHMTQRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKELL

SEQ ID NO: 43682 - protein, 156 aa, Homo sapiens
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQR

SEQ ID NO: 43683 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 43684 - protein, 735 aa, Homo sapiens; identical to SEQ ID NO: 43683

SEQ ID NO: 43685 - protein, 247 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNRPITCVGARRL

SEQ ID NO: 43686 - protein, 116 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLE

SEQ ID NO: 43687 - protein, 58 aa, Homo sapiens
MAKERGLISPSDFAQLQKYMEYSTKKVSDVLKLFEDGEMAKYVQGDAIGYEGFQQFLK

SEQ ID NO: 43688 - protein, 21 aa, Homo sapiens
MAKERGLISPSDFAQLQKYME

SEQ ID NO: 43689 - protein, 147 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAE

SEQ ID NO: 43690 - protein, 735 aa, Homo sapiens; identical to SEQ ID NO: 43683

SEQ ID NO: 43691 - protein, 133 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSS

SEQ ID NO: 43692 - protein, 107 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLE

SEQ ID NO: 43693 - protein, 44 aa, Homo sapiens
MAKERGLISPSDFAQLQKYMEYSTKKVSDVLKLFEDGEMAKYVQ

SEQ ID NO: 43694 - protein, 44 aa, Homo sapiens; identical to SEQ ID NO: 43693

SEQ ID NO: 43695 - protein, 133 aa, Homo sapiens; identical to SEQ ID NO: 43691

SEQ ID NO: 43696 - protein, 44 aa, Homo sapiens; identical to SEQ ID NO: 43693

SEQ ID NO: 43697 - protein, 804 aa, Homo sapiens
MTNQEKWAHLSPSEFSQLQKYAEYSTKKLKDVLEEFHGNGVLAKYNPEGKLVVLGNTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 43698 - protein, 804 aa, Homo sapiens [sequence omitted]

SEQ ID NO: 43699 - protein, 803 aa, Homo sapiens
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 43700 - protein, 804 aa, Homo sapiens [sequence omitted]

SEQ ID NO: 43701 - protein, 773 aa, Homo sapiens
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTVSTE

SEQ ID NO: 43702 - protein, 796 aa, Homo sapiens
MTNQEKWAHLSPSEFSQLQKYAEYSTKKLKDVLEEFHGNGVLAKYNPEGTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 43703 - protein, 75 aa, Homo sapiens
MTNQEKWAHLSPSEFSQLQKYAEYSTKKLKDVLEEFHGNGVLAKYNPEGKQDILNQTIDFEGFKLFMKTFLEAEL

SEQ ID NO: 43704 - protein, 785 aa, Homo sapiens
MTNQEKWAHLSPSEFSQLQKYAEYSTKKLKDVLEEFHGNGVLAKYNPEGTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 43705 - protein, 1214 aa, Homo sapiens
MAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 43706 - protein, 1170 aa, Homo sapiens
MNMFLYFQTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 43707 - protein, 567 aa, Homo sapiens
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRLILKCSMMPMQVDGEPWAQGPCTVTITHKTHAMMLYFSGEQTDDDISSTSDQEDIKATE

SEQ ID NO: 43708 - protein, 791 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 43709 - protein, 766 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 43710 - protein, 752 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 43711 - protein, 605 aa, Homo sapiens
SLKMGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELEWC

SEQ ID NO: 43712 - protein, 732 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEFHRKCELSTLCDGGELRDHILLPTSICPITRYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 43713 - protein, 1065 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 43714 - protein, 1068 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDIHQVQTADLRRVSAPPGSFTIPQSVPDRLRIRVNKISLQDYEGFHYDKEKLREASIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 43715 - protein, 982 aa, Homo sapiens
MNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDATSADRFYRIDRSQEHLHFVMEISQDEIFILDPDMVVSQPAGTPPGMPDLVVEQASGSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 43716 - protein, 942 aa, Homo sapiens
MAAAAEPGARAWLGGGSPRPGSPACSPVLGSGGRARPGPGPGPGPERAGVRAPGPAAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADAAPAPESDPR

SEQ ID NO: 43717 - protein, 543 aa, Homo sapiens
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVRTQIWCPATLRRASPCFISNRTISGTTKSLPRWSAMPQGAPSCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 43718 - protein, 1042 aa, Homo sapiens
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMQYVLYVRLAILVIEFIYAIVGIVWLTQYYTSCNDLTAKNVTLGMVVCNWVVILSVCITVLCVFDPTGRTFVKLRATKRRQRNLRTYNLRHRLEEGQATSWSRRLKVFLCCTRTKDSQSDAYSEIAYLFAEFFRDLDIVPSDIIAGLVLLRQRQRAKRNAVLDEANNDILAFLSGMPVTRNTKYLDLKNSQEMLRYKEVCYYMLFALAAYGWPMYLMRKPACGLCQLARSCSCCLCPARPRFAPGVTIEEDNCCGCNAIAIRRHFLDENMTAVDIVYTSCHDAVYETPFYVAVDHDKKKVVISIRGTLSPKDALTDLTGDAERLPVEGHHGTWLGHKGMVLSAEYIKKKLEQEMVLSQAFGRDLGRGTKHYGLIVVGHSLGAGTAAILSFLLRPQYPTLKCFAYSPPGGLLSEDAMEYSKEFVTAVVLGKDLVPRIGLSQLEGFRRQLLDVLQRSTKPKWRIIVGATKCIPKSELPEEVEVTTLASTRLWTHPSDLTIALSASTPLYPPGRIIHVVHNHPAEQCCCCEQEEPTYFAIWGDNKAFNEVIISPAMLHEHLPYVVMEGLNKVLENYNKGKTALLSAAKVMVSPTEVDLTPELIFQQQPLPTGPPMPTGLALELPTADHRNSSVRSKSQSEMSLEGFSEGRLLSPVVAAAARQDPVELLLLSTQERLAAELQARRAPLATMESLSDTESLYSFDSRRSSGFRSIRGSPSLHAVLERDEGHLFYIDPAIPEENPSLSSRTELLAADSLSKHSQDTQPLEAALGSGGVTPERPPSAAANDEEEEVGGGGGGPASRGELALHNGRLGDSPSPQVLEFAEFIDSLFNLDSKSSSFQDLYCMVVPESPTSDYAEGPKSPSQQEILLRAQFEPNLVPKPPRLFAGSADPSSGISLSPSFPLSSSGELMDLTPTGLSSQECLAADKIRTSTPTGHGASPAKQDELVISAR

SEQ ID NO: 43719 - protein, 672 aa, Homo sapiens
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 43720 - protein, 220 aa, Homo sapiens
MYCVSHHVCQHERTQIWCPATLRRASPCFISNRTISGTTKSLPRWSAMPQGAPSCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWR

SEQ ID NO: 43721 - protein, 379 aa, Homo sapiens
MYCVSHHVCQHESWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQQSSAGIFSELHRVTRPGEGCDSQAQCDQLGRSEEKNLASGRALQ

SEQ ID NO: 43722 - protein, 267 aa, Homo sapiens
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNTRATGNCPRNDGLTLLSLN

SEQ ID NO: 43723 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 43724 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 43725 - protein, 345 aa, Homo sapiens
MKTLIAAYSGVLRGERQAEADRSQRSHGGPALSREGSGRWGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 43726 - protein, 1101 aa, Homo sapiens
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTSFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPDNRRVPLERSRSRHNGAISSK

SEQ ID NO: 43727 - protein, 1096 aa, Homo sapiens [sequence omitted]

SEQ ID NO: 43728 - protein, 1096 aa, Homo sapiens
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTSFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPVVNHPCATRANPRSAT

SEQ ID NO: 43729 - protein, 1097 aa, Homo sapiens
MEQPGAAASGAGGGSEEPGGGRSNKRSAGNRAANEEETKNKPKLRDRITSFRKSTVKKEKPLIQHPIDSQVAMSEFPAAQPLYDERSLNLSEKEVLDLFEKMMEDMNLNEEKKAPLRNKDFTTKREMVVQYISATAKSVISSHIKGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTIFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPDNRRVPLERSRSRHNGAISSK

SEQ ID NO: 43730 - protein, 1101 aa, Homo sapiens [sequence omitted]

SEQ ID NO: 43731 - protein, 1103 aa, Homo sapiens [sequence omitted]

SEQ ID NO: 43732 - protein, 244 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 43733 - protein, 1922 aa, Homo sapiens
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 43734 - protein, 1922 aa, Homo sapiens; identical to SEQ ID NO: 43733

SEQ ID NO: 43735 - protein, 1922 aa, Homo sapiens; identical to SEQ ID NO: 43733

SEQ ID NO: 43736 - protein, 1922 aa, Homo sapiens; identical to SEQ ID NO: 43733

SEQ ID NO: 43737 - protein, 70 aa, Homo sapiens
MKSPALQPLSMAGLQLMTPASSPMGPFFGLPWQQEAIHDNIYTPRKYQVELLEAALDHNTIVCLNTGSGK

SEQ ID NO: 43738 - protein, 70 aa, Homo sapiens; identical to SEQ ID NO: 43737

SEQ ID NO: 43739 - protein, 1829 aa, Homo sapiens
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSEKSFLQMYPVPLCENCLKWNQKLPNLARLRELTTGRSESLWK

SEQ ID NO: 43740 - protein, 820 aa, Homo sapiens
MLAWESDHFLRILAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 43741 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 43742 - protein, 224 aa, Homo sapiens
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 43743 - protein, 139 aa, Homo sapiens [sequence omitted]

SEQ ID NO: 43744 - protein, 242 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 43745 - protein, 199 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKT

SEQ ID NO: 43746 - protein, 631 aa, Homo sapiens
MALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTANRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 43747 - protein, 184 aa, Homo sapiens
MALRKELLKSIWYAFTALDVEKSGKVSKSQLKVLSHNLYTVLHIPHDPVALEEHFRDDDDGPVSSQGYMPYLNKYILDKDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQG

SEQ ID NO: 43748 - protein, 130 aa, Homo sapiens
  MOD_RES (1)..(1): Any amino acid
XRDDDDGPVSSQGYMPYLNKYILDKDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQG

SEQ ID NO: 43749 - protein, 376 aa, Homo sapiens
MICPPRPPKVLGLQVLPDRDGKRCMFCVKTANRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 43750 - protein, 235 aa, Homo sapiens
MTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 43751 - protein, 507 aa, Homo sapiens
PLANEKTTLSPAEPTENGERTPFTNEKTTPSSAEPTEHGERTPLANEITTPSRAEPTEHGERIANEKATPSPAKPTEHGETTVNEDTTPSSAEPTENGERTPLANENTTTSPTESTEHGERTANEKTTPSPAEPTEHGERTPSANEKTIPSPAKPTEHEEMTPSANENTTPSPVKPTEHGEKTTLANEKITLSPEGPTEHGAKTTSANEKITPSLAKPTEHGERTTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 43752 - protein, 507 aa, Homo sapiens
PLANEKTTLSPAEPTENGERTPFTNEKTTPSSAEPTEHGERTPLANEITTPSRAEPTEHGERIANEKATPSPAKPTEHGETTVNEDTTPSSAEPTENGERTPLANENTTTSPTESTEHGERTANEKTTPSPAEPTEHGERTPSANEKTIPSPAKPTEHEEMTPSANENTTPSPVKPTEHGEKTTLANEKITLSPEGPTEHGAKTTSANEKITPSLAKPTEHGERTTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNKSHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 43753 - protein, 507 aa, Homo sapiens; identical to SEQ ID NO: 43751

SEQ ID NO: 43754 - protein, 517 aa, Homo sapiens
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 43755 - protein, 517 aa, Homo sapiens; identical to SEQ ID NO: 43754

SEQ ID NO: 43756 - protein, 517 aa, Homo sapiens; identical to SEQ ID NO: 43754

SEQ ID NO: 43757 - protein, 1393 aa, Homo sapiens [sequence omitted]

SEQ ID NO: 43758 - protein, 889 aa, Homo sapiens
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENTTLSPAEPTENRERTANENTAPFPAGPTENREMTANENTTLFPAEPTEHGERTANENTTPSPAEPTEHGERTANENTTPSPAEPTEHGERTPFANDKTTSSSAESTEHGERTPLANENTTPSPAEPTENRERTANENTTPSPAGPTENRETTANEKTTLSPVEPTENRETTANEKTTPSPAEPTENGQRTPFANEKTTSSSAEPTEHGERTPLANENTTPSPAEPTENRERTANEKTTPSPAEPTENGDRTPLANEKTTPSLAEPTENGQRTPFANEKTTSSSAEPTEHEERTPLANENTTPSPAEPTENRERTANENTTPSPAGPTENREMTANEKTTLFPAEPTENRERTANEKTTSSPAEPTENGQRTPFANEKTTSSSAEPTEHGERTPLANENTTLSPAGPTENRERTANEKTTPFPAEPTENRERTANENTTPSPAQPTENGDRTPLANEKTTPSLAEPTENGKRTPFANEKTTSSSAEPTEHAERTPLANENTTSSPAEPTENRERTANEKTTQFPAEPTENRESTANEKTTPFPAEPTENREWTANENTTLSPAEPTEHEEMTPLA

SEQ ID NO: 43759 - protein, 550 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 43760 - protein, 327 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCSPLSCTARAT

SEQ ID NO: 43761 - protein, 509 aa, Homo sapiens
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 43762 - protein, 269 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSRKCPTGWHHYEGTASCYRVYLSGENYWDAAQTCQRLNGSLATFSTDQELRFVLAQEWDQPERSFGWKDQRKLWVGYQYVITGRNRSLEGRWEVAFKDWGVSDTMVHRRLLCPCVGTLHTHLKLGARFRRVPVRLGGALSRRSPRPTPACEPRLGAKTLQV

SEQ ID NO: 43763 - protein, 220 aa, Homo sapiens
MERYAGALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 43764 - protein, 220 aa, Homo sapiens
MERYAAALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVVQAAQQRELEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 43765 - protein, 773 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 43766 - protein, 740 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 43767 - protein, 740 aa, Homo sapiens; identical to SEQ ID NO: 43766

SEQ ID NO: 43768 - protein, 125 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFT

SEQ ID NO: 43769 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 43770 - protein, 187 aa, Homo sapiens; identical to SEQ ID NO: 43769

SEQ ID NO: 43771 - protein, 320 aa, Homo sapiens
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKYYFSWKS

SEQ ID NO: 43772 - protein, 482 aa, Homo sapiens
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVSQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 43773 - protein, 301 aa, Homo sapiens
MENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVSQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 43774 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 43775 - protein, 509 aa, Homo sapiens; identical to SEQ ID NO: 43774

SEQ ID NO: 43776 - protein, 461 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 43777 - protein, 486 aa, Homo sapiens
MQSWSRVYCSLAKRGHFNRISHGLQGLSAVPLRTYADQPIDADVTVIGSGPGGYVAAIKAAQLGFKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 43778 - protein, 410 aa, Homo sapiens
MAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 43779 - protein, 459 aa, Homo sapiens
MLIYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 43780 - protein, 647 aa, Homo sapiens
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 43781 - protein, 225 aa, Homo sapiens
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGKPEDIEAFKNYTLDSSAAPTPQAAPAPTPAATASPPTPSAQAPGSSYPPHMQVLLPALSPTMTMGTVQRWEKKVGEKLSEGDLLAEMSL

SEQ ID NO: 43782 - protein, 418 aa, Homo sapiens
MQAGTIARWEKKEGDKINEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 43783 - protein, 367 aa, Homo sapiens
MTWLQSKPQRLQNLSQREMSGGRKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 43784 - protein, 453 aa, Homo sapiens
MLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 43785 - protein, 395 aa, Homo sapiens
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 43786 - protein, 519 aa, Homo sapiens
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 43787 - protein, 572 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 43788 - protein, 536 aa, Homo sapiens
MEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 43789 - protein, 572 aa, Homo sapiens; identical to SEQ ID NO: 43787

SEQ ID NO: 43790 - protein, 536 aa, Homo sapiens; identical to SEQ ID NO: 43788

SEQ ID NO: 43791 - protein, 198 aa, Homo sapiens
MSVIWDKAVVTGKMDENQFVAVTSTNAAKVFNLYPRKGRIAVGSDADLVIWDPDSVKTIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 43792 - protein, 684 aa, Homo sapiens
MASGRRGWDSSHEDDLPVYLARPGTTDQVPRQKYGGMFCNVEGAFESKTLDFDALSVGQRGAKTPRSGQGSDRGSGSRPGIEGDTPRRGQGREESREPAPASPAPAGVEIRSATGKEVLQNLGPKDKSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 43793 - protein, 570 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 43794 - protein, 92 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQG

SEQ ID NO: 43795 - protein, 196 aa, Homo sapiens [sequence omitted]

SEQ ID NO: 43796 - protein, 572 aa, Homo sapiens
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 43797 - protein, 412 aa, Homo sapiens
MPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 43798 - protein, 412 aa, Homo sapiens; identical to SEQ ID NO: 43797

SEQ ID NO: 43799 - protein, 564 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQGKVVLAETTTAHATLTGLHYYHQDWSHAAAYVTVPPLRLDTNTSTYLMSLLANDTLNIVASDHRPFTTKQKAMGKEDFTKIPHGVSGVQDRMSVIWERGVVGGKMDENRFVAVTSSNAAKLLNLYPRKGRIIPGADADVVVWDPEATKTISASTQVQGGDFNLYENMRCHGVPLVTISRGRVVYENGVFMCAEGTGKFCPLRSFPDTVYKKLVQREKTLKVRGVDRTPYLGDVAVVVHPGKKEMGTPLADTPTRPVTRHGGMRDLHESSFSLSGSQIDDHVPKRASARILAPPGGRSSGIW

SEQ ID NO: 43800 - protein, 564 aa, Homo sapiens; identical to SEQ ID NO: 43799

SEQ ID NO: 43801 - protein, 190 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARV

SEQ ID NO: 43802 - protein, 174 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSEL

SEQ ID NO: 43803 - protein, 165 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKD

SEQ ID NO: 43804 - protein, 173 aa, Homo sapiens
MAPVLSKDSADIESILALNPRTQTHATLRSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATETLILAFSLMNHL

SEQ ID NO: 43805 - protein, 1025 aa, Homo sapiens [sequence omitted]

SEQ ID NO: 43806 - protein, 156 aa, Homo sapiens
MAPVLSKDSADIENCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVNGLLHFQNSVSLWFQKTANISFLSCGSLQDA

SEQ ID NO: 43807 - protein, 493 aa, Homo sapiens
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 43808 - protein, 493 aa, Homo sapiens; identical to SEQ ID NO: 43807

SEQ ID NO: 43809 - protein, 458 aa, Homo sapiens
MILNSLSLCYHNKLILAPMVRVGTLPMRLLALDYGADIVYCEELIDLKMIQCKRVVNEVLSTVDFVAPDDRVVFRTCEREQNRVVFQMGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 43810 - protein, 285 aa, Homo sapiens
MAGLGHPAAFGRATHAVVRALPESLGQHALRSAKGEEVDVARAERQHQLYVGVLGSKLGLQVVELPADESLPDCVFVEDVAVVCEETALITRPGAPSRRKEVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 43811 - protein, 192 aa, Homo sapiens
MWLYGLGQVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 43812 - protein, 182 aa, Homo sapiens
MMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 43813 - protein, 285 aa, Homo sapiens; identical to SEQ ID NO: 43810

SEQ ID NO: 43814 - protein, 185 aa, Homo sapiens
MVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 43815 - protein, 285 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 43816 - protein, 285 aa, Homo sapiens; identical to SEQ ID NO: 43815

SEQ ID NO: 43817 - protein, 285 aa, Homo sapiens; identical to SEQ ID NO: 43815

SEQ ID NO: 43818 - protein, 285 aa, Homo sapiens; identical to SEQ ID NO: 43815

SEQ ID NO: 43819 - protein, 285 aa, Homo sapiens; identical to SEQ ID NO: 43815

SEQ ID NO: 43820 - protein, 285 aa, Homo sapiens; identical to SEQ ID NO: 43815

SEQ ID NO: 43821 - protein, 285 aa, Homo sapiens; identical to SEQ ID NO: 43815

SEQ ID NO: 43822 - protein, 188 aa, Homo sapiens
  MOD_RES (1)..(1): Any amino acid
XRRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRMTQLLTVSFFVLGCLVCPLSSCTVEVGICPTARRHCRSSLMSPWYLCPAQNWRRLAPGSAPSAWCSAHAPTAEGLALGYCWPGVG

SEQ ID NO: 43823 - protein, 188 aa, Homo sapiens; identical to SEQ ID NO: 43822
  MOD_RES (1)..(1): Any amino acid

SEQ ID NO: 43824 - protein, 285 aa, Homo sapiens; identical to SEQ ID NO: 43815

SEQ ID NO: 43825 - protein, 285 aa, Homo sapiens; identical to SEQ ID NO: 43815

SEQ ID NO: 43826 - protein, 285 aa, Homo sapiens; identical to SEQ ID NO: 43815

SEQ ID NO: 43827 - protein, 236 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLH

SEQ ID NO: 43828 - protein, 226 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPG

SEQ ID NO: 43829 - protein, 236 aa, Homo sapiens; identical to SEQ ID NO: 43827

SEQ ID NO: 43830 - protein, 285 aa, Homo sapiens; identical to SEQ ID NO: 43815

SEQ ID NO: 43831 - protein, 285 aa, Homo sapiens; identical to SEQ ID NO: 43815

SEQ ID NO: 43832 - protein, 285 aa, Homo sapiens; identical to SEQ ID NO: 43815

SEQ ID NO: 43833 - protein, 226 aa, Homo sapiens; identical to SEQ ID NO: 43828

SEQ ID NO: 43834 - protein, 285 aa, Homo sapiens; identical to SEQ ID NO: 43815

SEQ ID NO: 43835 - protein, 226 aa, Homo sapiens; identical to SEQ ID NO: 43828

SEQ ID NO: 43836 - protein, 226 aa, Homo sapiens; identical to SEQ ID NO: 43828

SEQ ID NO: 43837 - protein, 285 aa, Homo sapiens; identical to SEQ ID NO: 43815

SEQ ID NO: 43838 - protein, 226 aa, Homo sapiens; identical to SEQ ID NO: 43828

SEQ ID NO: 43839 - protein, 188 aa, Homo sapiens; identical to SEQ ID NO: 43822
  MOD_RES (1)..(1): Any amino acid

SEQ ID NO: 43840 - protein, 188 aa, Homo sapiens; identical to SEQ ID NO: 43822
  MOD_RES (1)..(1): Any amino acid

SEQ ID NO: 43841 - protein, 226 aa, Homo sapiens; identical to SEQ ID NO: 43828

SEQ ID NO: 43842 - protein, 285 aa, Homo sapiens; identical to SEQ ID NO: 43815

SEQ ID NO: 43843 - protein, 236 aa, Homo sapiens; identical to SEQ ID NO: 43827

SEQ ID NO: 43844 - protein, 236 aa, Homo sapiens; identical to SEQ ID NO: 43827

SEQ ID NO: 43845 - protein, 285 aa, Homo sapiens; identical to SEQ ID NO: 43815

SEQ ID NO: 43846 - protein, 225 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRP

SEQ ID NO: 43847 - protein, 285 aa, Homo sapiens; identical to SEQ ID NO: 43815

SEQ ID NO: 43848 - protein, 188 aa, Homo sapiens; identical to SEQ ID NO: 43822
  MOD_RES (1)..(1): Any amino acid

SEQ ID NO: 43849 - protein, 188 aa, Homo sapiens; identical to SEQ ID NO: 43822
  MOD_RES (1)..(1): Any amino acid

SEQ ID NO: 43850 - protein, 285 aa, Homo sapiens; identical to SEQ ID NO: 43815

SEQ ID NO: 43851 - protein, 236 aa, Homo sapiens; identical to SEQ ID NO: 43827

SEQ ID NO: 43852 - protein, 188 aa, Homo sapiens; identical to SEQ ID NO: 43822
  MOD_RES (1)..(1): Any amino acid

SEQ ID NO: 43853 - protein, 285 aa, Homo sapiens; identical to SEQ ID NO: 43815

SEQ ID NO: 43854 - protein, 285 aa, Homo sapiens; identical to SEQ ID NO: 43815

SEQ ID NO: 43855 - protein, 236 aa, Homo sapiens; identical to SEQ ID NO: 43827

SEQ ID NO: 43856 - protein, 236 aa, Homo sapiens; identical to SEQ ID NO: 43827

SEQ ID NO: 43857 - protein, 866 aa, Homo sapiens
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 43858 - protein, 573 aa, Homo sapiens
MERQSRNSDNWRWLCWCESGLSPGQSRDERCGPAGEIRAHGWIYLARRFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 43859 - protein, 613 aa, Homo sapiens
YLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 43860 - protein, 624 aa, Homo sapiens
MTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 43861 - protein, 394 aa, Homo sapiens
MWSCWRNQSSRLDLPGTQYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 43862 - protein, 1576 aa, Homo sapiens
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGKLWSRSLKLAYTLLNKLGTKNEPVLKPGDRVALVYPNNDPVMFMVAFYGCLLAEVIPVPIEVPLTRKDAGGQQIGFLLGSCGIALALTSEVCLKGLPKTQNGEIVQFKGWPRLKWVVTDSKYLSKPPKDWQPHISPAGTEPAYIEYKTSKEGSVMGVTVSRLAMLSHCQALSQACNYSEGETIVNVLDFKKDAGLWHGMFANVMNKMHTISVPYSVMKTCPLSWVQRVHAHKAKVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 43863 - protein, 392 aa, Homo sapiens
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSEFSLVRIYSEDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGESARFQILLS

SEQ ID NO: 43864 - protein, 1556 aa, Homo sapiens
MADRSLEGMALPLEVRARLAELELELSEGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 43865 - protein, 656 aa, Homo sapiens
MAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEHTSNKGK

SEQ ID NO: 43866 - protein, 198 aa, Homo sapiens
MSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQCWDYRHEPPRPAPKCFKMVYKEGVRSVGEDKIREKRTKTWR

SEQ ID NO: 43867 - protein, 231 aa, Homo sapiens
  MOD_RES (1)..(1): Any amino acid
XETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEHTSNKGK

SEQ ID NO: 43868 - protein, 187 aa, Homo sapiens
MADRSLEGMALPLEVRARLAELELELSEGDITQKGYEKKRSKLIGAYLPQPPTANGAAVVRCRLQHSEGAPRRTFRSAHIGVCDVREAAARERVASTAGNRPLFYFRFGVDQALPQERRAPVTPSSASRYHRRRSSGSRDERYRSDVHTEAVQAALAKHKERKMAVPMPSKRRSLVVQTSMDAYTPP

SEQ ID NO: 43869 - protein, 155 aa, Homo sapiens
  MOD_RES (1)..(1): Any amino acid
XVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQCWDYRHEPPRPAPKCFKMVYKEGVRSVGEDKIREKRTKTWR

SEQ ID NO: 43870 - protein, 481 aa, Homo sapiens
IWVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 43871 - protein, 371 aa, Homo sapiens
MHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRVRRGAGLPWLLASRGLAWFLGALLLLSLNPFASVLWEFFLCFAILTETFVPRDCF

SEQ ID NO: 43872 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 43873 - protein, 411 aa, Homo sapiens; identical to SEQ ID NO: 43872

SEQ ID NO: 43874 - protein, 411 aa, Homo sapiens; identical to SEQ ID NO: 43872

SEQ ID NO: 43875 - protein, 126 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGSGQPMCHARPRTGMPCASPWSRLTSYAACVPPILSWSL

SEQ ID NO: 43876 - protein, 399 aa, Homo sapiens
MQPSGLEGPGTFGRWPLLSLLLLLLLLQPVTCAYTTPGPPRALFWSAYVPCQTQDRDALRLTLEQIDLIRRMCASYSELELVTSAKALNDTQKLACLIGVEGGHSLDNSLSILPTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 43877 - protein, 486 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILPTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 43878 - protein, 486 aa, Homo sapiens; identical to SEQ ID NO: 43877

SEQ ID NO: 43879 - protein, 513 aa, Homo sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 43880 - protein, 789 aa, Homo sapiens
MRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 43881 - protein, 800 aa, Homo sapiens
MTAAKQEPQPTPGARASQAQPADQELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 43882 - protein, 796 aa, Homo sapiens
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 43883 - protein, 97 aa, Homo sapiens
MSVILLTPDELTNSSETRLSLEDLFRKDFVLHDPEARWINDTDVVYKSENGHVIKLNIETNATTLLLENTTFVTFKASRHSVSPDLKYVLLAYDVKQ

SEQ ID NO: 43884 - protein, 600 aa, Homo sapiens
LSILILTSNELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGK

SEQ ID NO: 43885 - protein, 746 aa, Homo sapiens
MSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 43886 - protein, 317 aa, Homo sapiens
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 43887 - protein, 737 aa, Homo sapiens
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 43888 - protein, 737 aa, Homo sapiens; identical to SEQ ID NO: 43887

SEQ ID NO: 43889 - protein, 90 aa, Homo sapiens
MADTQYILPNDIGVSSLDCREAFRLLSPTERLYAYHLSRAAWYGGLAVLLQTSPEAPYIYALLSRLFRAQDPDQLRQHALAEGLTEEEYQ

SEQ ID NO: 43890 - protein, 201 aa, Homo sapiens
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLF

SEQ ID NO: 43891 - protein, 757 aa, Homo sapiens
MGEPEAGSEFANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 43892 - protein, 756 aa, Homo sapiens
MGEPEAGSEFANGAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 43893 - protein, 737 aa, Homo sapiens; identical to SEQ ID NO: 43887

SEQ ID NO: 43894 - protein, 635 aa, Homo sapiens
MGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 43895 - protein, 803 aa, Homo sapiens
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 43896 - protein, 865 aa, Homo sapiens
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 43897 - protein, 801 aa, Homo sapiens
MKEKAMIKTAKMQGNVMELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 43898 - protein, 758 aa, Homo sapiens
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 43899 - protein, 882 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43900 - protein, 849 aa, Homo sapiens
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43901 - protein, 847 aa, Homo sapiens
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43902 - protein, 725 aa, Homo sapiens
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43903 - protein, 898 aa, Homo sapiens
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43904 - protein, 782 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 43905 - protein, 898 aa, Homo sapiens; identical to SEQ ID NO: 43903

SEQ ID NO: 43906 - protein, 1222 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 43907 - protein, 1243 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 43908 - protein, 1222 aa, Homo sapiens; identical to SEQ ID NO: 43906

SEQ ID NO: 43909 - protein, 1278 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNDHDSQNEDGGMVKEMESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDDATRGSAVKRFSISFARHPTNEHLHLYRCWSVSSVEFLGSSGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 43910 - protein, 58 aa, Homo sapiens
MSEAPRFFVGPEDTEINPGNYRHFFHHADEDDEEEDDSPPERQIVVGICSMAKKSKSK

SEQ ID NO: 43911 - protein, 958 aa, Homo sapiens
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 43912 - protein, 796 aa, Homo sapiens
MSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 43913 - protein, 928 aa, Homo sapiens
MLKSKTFLKKTRAGGVMKIVREHYLRDDIGCGAPGCAACGGAHEGPALEPQPQDPASSVCPQPHYLLPDTNVLLHQIVSAWRPGTWASVASSLRLPGSLETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 43914 - protein, 971 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLDEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 43915 - protein, 1054 aa, Homo sapiens
MLQKREKVLLLRTFQGRTLRIVREHYLRPCVPCHSPLCPQPAACSHDGKLLSSDVTHYVIPDWKVVQDYLEILEFPELKGIIFMQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLDEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 43916 - protein, 253 aa, Homo sapiens
MEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGLQGGRAHRFLGVNICVSKWTFCACFRKNRRSGRGNCNHPGGKQYFSYSFLRSSDV

SEQ ID NO: 43917 - protein, 150 aa, Homo sapiens
MEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKA

SEQ ID NO: 43918 - protein, 57 aa, Homo sapiens
MQTACQAVQHQRGRRQYNKLRNLLKDARHDCILFANEFQQCCYLPRERGESMEKWQT

SEQ ID NO: 43919 - protein, 97 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGV

SEQ ID NO: 43920 - protein, 103 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFK

SEQ ID NO: 43921 - protein, 603 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQQNADKDGAAHLQASHSPSAEDAEAQPSTEERLPETRGICDRDPDTRLFFLQQQSRVLEAKPQNTIRVEEQTTQLQI

SEQ ID NO: 43922 - protein, 885 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQVITIFSLVEVVLQAESTALKYSAILKRPGTQGHLGPEKEEEESDGEPEDSSTS

SEQ ID NO: 43923 - protein, 356 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKDNEIEAQRSSWAYPVSHRKSEERMVMHRLQKMRPPAFHKTQELYRRNPCKDQQRWFTSWRKNILEQQPASSNSWLIRTANCLGNTPCFLPQTTECLEFMCLSRTVPRTLWHGLKIMPTHCSSAALWTGRRTAILPWGSWLRVLGRLVKLSLKQKEY

SEQ ID NO: 43924 - protein, 885 aa, Homo sapiens; identical to SEQ ID NO: 43922

SEQ ID NO: 43925 - protein, 249 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVIAYRFSPRVQMAFT

SEQ ID NO: 43926 - protein, 675 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRLPVPPHWL

SEQ ID NO: 43927 - protein, 144 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEE

SEQ ID NO: 43928 - protein, 619 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKPCCAGTPRPKQGCSVTWWNSATRWGCPWTSAPQEPSMKA

SEQ ID NO: 43929 - protein, 204 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQP

SEQ ID NO: 43930 - protein, 213 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQVISETSRGFRFKSD

SEQ ID NO: 43931 - protein, 588 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 43932 - protein, 239 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGA

SEQ ID NO: 43933 - protein, 555 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 43934 - protein, 555 aa, Homo sapiens; identical to SEQ ID NO: 43933

SEQ ID NO: 43935 - protein, 555 aa, Homo sapiens; identical to SEQ ID NO: 43933

SEQ ID NO: 43936 - protein, 537 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQPVSNGYSFEDFEERFAAATPAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 43937 - protein, 553 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 43938 - protein, 469 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 43939 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 43940 - protein, 552 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 43941 - protein, 67 aa, Homo sapiens
MSNEVETSATNGQPDQQAAPKAPSKKEKKKGPEKTDEYLLARFKGDGVKYKAKLIGIDDVPDARGDK

SEQ ID NO: 43942 - protein, 76 aa, Homo sapiens
MSNEVETSATNGQPDQQAAPKAPSKKEKKKGPEKTDEYLLARFKGDGVKYKAKLIGIDDVPDARGDKMSQDSMMKL

SEQ ID NO: 43943 - protein, 39 aa, Homo sapiens
MSNEVETSATNGQPDQQAAPKAPSKKEKKKGPEKTDEYL

SEQ ID NO: 43944 - protein, 749 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 43945 - protein, 855 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 43946 - protein, 855 aa, Homo sapiens; identical to SEQ ID NO: 43945

SEQ ID NO: 43947 - protein, 148 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPY

SEQ ID NO: 43948 - protein, 171 aa, Homo sapiens
  MOD_RES (1)..(1): Any amino acid
XIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVS

SEQ ID NO: 43949 - protein, 130 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWI

SEQ ID NO: 43950 - protein, 166 aa, Homo sapiens
LKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRVSREKPQQASGRYDTPAPSSLHLFLVSANLLRSPHSLSRFGLPLLLA

SEQ ID NO: 43951 - protein, 148 aa, Homo sapiens; identical to SEQ ID NO: 43947

SEQ ID NO: 43952 - protein, 800 aa, Homo sapiens
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYLILITDEYGCSKGGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43953 - protein, 788 aa, Homo sapiens
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43954 - protein, 512 aa, Homo sapiens
MERARKFSGSGLAMGLGSASASAWRRASQRWAWPLRSLRPGGDAREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 43955 - protein, 1006 aa, Homo sapiens
EEEAGDLVQPGISFPGPAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 43956 - protein, 975 aa, Homo sapiens
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 43957 - protein, 978 aa, Homo sapiens
  MOD_RES (1)..(1): Any amino acid
XPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 43958 - protein, 853 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43959 - protein, 926 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43960 - protein, 893 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43961 - protein, 917 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYLILITDEYGCSKGRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43962 - protein, 891 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLIGGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43963 - protein, 208 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLE

SEQ ID NO: 43964 - protein, 871 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43965 - protein, 106 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVE

SEQ ID NO: 43966 - protein, 370 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITN

SEQ ID NO: 43967 - protein, 904 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 43968 - protein, 154 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSH

SEQ ID NO: 43969 - protein, 853 aa, Homo sapiens; identical to SEQ ID NO: 43958

SEQ ID NO: 43970 - protein, 36 aa, Homo sapiens
MPVRKQDTQRALHLLEEYRSKLSQTEDRQLRSSIER

SEQ ID NO: 43971 - protein, 123 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISP

SEQ ID NO: 43972 - protein, 904 aa, Homo sapiens; identical to SEQ ID NO: 43967

SEQ ID NO: 43973 - protein, 893 aa, Homo sapiens; identical to SEQ ID NO: 43960

SEQ ID NO: 43974 - protein, 909 aa, Homo sapiens
MNAYLTKQHSCSRGSDGMDAVRSAPTLIRDAHCACGWQRNCQGLGYSSQTMPSSGPGGPASNRTGGSSFNRTLWDSVRKSPHKTSTKGKGTCGEHCTCPHGWFSPAQASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43975 - protein, 791 aa, Homo sapiens
MQHAFIPASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43976 - protein, 975 aa, Homo sapiens
MGIFKSSLFQALLDIQEFYEVTLLNSQKSCEQKIEEANQVLQKWEKTSLLAPCHDRLQKSSELTDCSGSKENASCIEQNKENQSFENETDETTTQNQGRCPAQNCSVEAPAWMPVHHCTKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43977 - protein, 334 aa, Homo sapiens
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43978 - protein, 870 aa, Homo sapiens
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43979 - protein, 348 aa, Homo sapiens
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLKHVSSNASDSESSYRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43980 - protein, 749 aa, Homo sapiens
MQRPSVSRAENYQLLWDTIASLKQCEQAMQHAFIPVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43981 - protein, 334 aa, Homo sapiens; identical to SEQ ID NO: 43977

SEQ ID NO: 43982 - protein, 866 aa, Homo sapiens
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLKHVSSNASDSESSYRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43983 - protein, 94 aa, Homo sapiens
MMNHSMSSGSGSLRTNQKRSLYVRAMFDYDKSKDSGLPSQGLSFKYGDILHVINASDDEWWQARRVMLEGDSEEMGVIPSKRRVERKERARLKT

SEQ ID NO: 43984 - protein, 852 aa, Homo sapiens
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43985 - protein, 620 aa, Homo sapiens [sequence omitted]

SEQ ID NO: 43986 - protein, 975 aa, Homo sapiens; identical to SEQ ID NO: 43976

SEQ ID NO: 43987 - protein, 975 aa, Homo sapiens
FGFIVSVHFQSYLNIQEFYEVTLLNSQKSCEQKIEEANQVLQKWEKTSLLAPCHDRLQKSSELTDCSGSKENASCIEQNKENQSFENETDETTTQNQGRCPAQNCSVEAPAWMPVHHCTKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 43988 - protein, 849 aa, Homo sapiens
MHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQARPAPLLVNPETLKHSLSVNGSDGMFKYEEIVLERGNSGLGFSIAGGIDNPHVPDDPGIFITKIIPGGAAAMDGRLGVNDCVLRVNEVDVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 43989 - protein, 817 aa, Homo sapiens
MHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEIVLERGNSGLGFSIAGGIDNPHVPDDPGIFITKIIPGGAAAMDGRLGVNDCVLRVNEVDVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 43990 - protein, 366 aa, Homo sapiens
MMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 43991 - protein, 767 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 43992 - protein, 721 aa, Homo sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 43993 - protein, 664 aa, Homo sapiens
MEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 43994 - protein, 724 aa, Homo sapiens
MDCLCIVTTKKYRYQDEDTPPLEHSPAHLPNQANSPPVIVNTDTLEAPGYVLQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 43995 - protein, 767 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYVLQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 43996 - protein, 667 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 43997 - protein, 1579 aa, Homo sapiens
MEPQRRELLAQCQQSLAQAMTEVEAVLGLLEAAGALSPGERRQLDEEAGGAKAELLLKLLLAKERDHFQDLRAALEKTQPHLLPILYLNGVVGPPQPAEGAGSTYSVLSTMPSDSESSSSLSSVGTTGKAPSPPPLLTDQQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELNKATAQNKDLQWEMELLQSELTELRTTQVKTAKESEKYREERDAVYSEYKLIMSERDQVISELDKLQTEVELAESKLKSSTSEKKAANEEMEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 43998 - protein, 1919 aa, Homo sapiens
MEPQRRELLAQCQQSLAQAMTEVEAVLGLLEAAGALSPGERRQLDEEAGGAKAELLLKLLLAKERDHFQDLRAALEKTQPHLLPILYLNGVVGPPQPAEGAGSTYSVLSTMPSDSESSSSLSSVGTTGKAPSPPPLLTDQQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELNKATAQNKDLQWEMELLQSELTELRTTQVKTAKESEKYREERDAVYSEYKLIMSERDQVISELDKLQTEVELAESKLKSSTSEKKAANEEMEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 43999 - protein, 683 aa, Homo sapiens
MEPQRRELLAQCQQSLAQAMTEVEAVLGLLEAAGALSPGERRQLDEEAGGAKAELLLKLLLAKERDHFQDLRAALEKTQPHLLPILYLNGVVGPPQPAEGAGSTYSVLSTMPSDSESSSSLSSVGTTVKHLREQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLE

SEQ ID NO: 44000 - protein, 880 aa, Homo sapiens
GAINMVVRRRKSLGGKVVTPLHINLSGQKDSGISLENGVYAAAVLPGSPAAKEGSLAVGDRIVAINGIALDNKSLNECESLLRSCQDSLTLSLLKEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 44001 - protein, 1078 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 44002 - protein, 882 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAFGNYMNKGQRGNAYGFKISSLNKIADTKSSIDKNITLLHYLITIVENKYPSVLNLNEELRDIPQAAKVKSWNIRSLSPHSPEISLCLLSASSSQ

SEQ ID NO: 44003 - protein, 1068 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 44004 - protein, 1078 aa, Homo sapiens; identical to SEQ ID NO: 44001

SEQ ID NO: 44005 - protein, 1068 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 44006 - protein, 1068 aa, Homo sapiens; identical to SEQ ID NO: 44005

SEQ ID NO: 44007 - protein, 132 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKVPSLTPLATSQGSWHGVALAALACSCIHLMFITCQPCSRCWRNNSE

SEQ ID NO: 44008 - protein, 1067 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVLEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 44009 - protein, 353 aa, Homo sapiens
MGALLCDHRSCRPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 44010 - protein, 444 aa, Homo sapiens
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 44011 - protein, 695 aa, Homo sapiens
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 44012 - protein, 670 aa, Homo sapiens
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 44013 - protein, 716 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 44014 - protein, 723 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVMVLRGWGA

SEQ ID NO: 44015 - protein, 699 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRTMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 44016 - protein, 104 aa, Homo sapiens
MPEAHMQPAKLQTSLPTTDHGSKKPVSCYLPPLSNAHPMCIEVQNAQNCSSAAATLEPSIISDTCFYKPITKDQLSSRSELNTVRLKCLNSLRGWKILNQLSLT

SEQ ID NO: 44017 - protein, 478 aa, Homo sapiens
MGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 44018 - protein, 547 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRRCV

SEQ ID NO: 44019 - protein, 369 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMELEPIALDPPWKPRHPEPNSY

SEQ ID NO: 44020 - protein, 238 aa, Homo sapiens
MDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAGTNCFGSTMEASTS

SEQ ID NO: 44021 - protein, 755 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYDGVSLCRPVWSAVVRSCSLQPLPPEFKQFSCLSLRSSWDYRCPPPCLANFVFLVEMGFYHVDQTGLKLLTSSDPPSSASQSAGITDMSHCAWPLQ

SEQ ID NO: 44022 - protein, 678 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYGYKYCDAESWTQRSQQLA

SEQ ID NO: 44023 - protein, 832 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKESYILSAELGEKCEDIGKKLLYLEDQLHTAIHSHDEDLIHSLRRELQMVKETLQAMILQLQPAKEAGEREAAASCMTAGVHEAQA

SEQ ID NO: 44024 - protein, 886 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKVETGFHYVGQAGLELLTSSNPPASASQSAGITAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIHSLRRELQMVKETLQAMILQLQPAKEAGEREAAASCMTAGVHEAQA

SEQ ID NO: 44025 - protein, 206 aa, Homo sapiens
  MOD_RES (1)..(1): Any amino acid
XNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKVLEEWKTHLIPSLHCAGGEQKEVCPFHMASRGDPYSKGCFGTMLQMGTINIGKASH

SEQ ID NO: 44026 - protein, 92 aa, Homo sapiens
MKYMETLKNKLCSCKCPLLGKVWEADLEACRLLIQSLQLQEARGSLSVEDERQMDDLEGAAPPIPPRLHSEDKRKTPLKVLEEWKTHLIPSL

SEQ ID NO: 44027 - protein, 854 aa, Homo sapiens [sequence omitted]

SEQ ID NO: 44028 - protein, 732 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQHLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIHSLRRELQMVKETLQAMILQLQPAKEAGEREAAASCMTAGVHEAQA

SEQ ID NO: 44029 - protein, 609 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRREVRHQTAPCRNHQLEKPVINIWAFHLRRKICLFQADGLQHGSAEVKHLKETSVEPAGSTASRKE

SEQ ID NO: 44030 - protein, 695 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYAASVHCLGKCGKLTWKLVDCLSRAYSSRKPGEACL

SEQ ID NO: 44031 - protein, 559 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRRNKCEGKYYEVHGNT

SEQ ID NO: 44032 - protein, 579 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKETISGRLKTSPRRLDH

SEQ ID NO: 44033 - protein, 129 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGQDLVPKQAIQVQEADEAGWGGSGG

SEQ ID NO: 44034 - protein, 171 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQ

SEQ ID NO: 44035 - protein, 255 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLMKQGGAALEGSALANGRALSAGSPPVPPGWNPNSSSGKGSGGNAGSYIPSYTSWYPSAHQEAMQQPQLM

SEQ ID NO: 44036 - protein, 187 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLM

SEQ ID NO: 44037 - protein, 328 aa, Homo sapiens
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVKIWFQNRRSKFKKMWKSGEIPSEQHPGASASPPCASPPVSAPASWDFGVPQRMAGGGGPGSGGSGAGSSGSSPSSAASAFLGNYPWYHQTSGSASHLQATAPLLHPTQTPQPHHHHHHHGGGGAPVSAGTIF

SEQ ID NO: 44038 - protein, 217 aa, Homo sapiens
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVGLAPCRGEESAGLRWLGSRRV

SEQ ID NO: 44039 - protein, 287 aa, Homo sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 44040 - protein, 240 aa, Homo sapiens
MTSLPCPLPGRDASKAVFPDLAPVPSVAAAYPLGLSPTTAASPNLSYSRPYGHLLSYPYTEPANPGDSYLSCQQPAALSQPLCGPAEHPQELEADSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 44041 - protein, 168 aa, Homo sapiens
MKLSVLPPRSLLAPYTVLCCPPDSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 44042 - protein, 289 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 44043 - protein, 265 aa, Homo sapiens
MMTMTTMADGLEGQDSSKSAFMEFGQQQQQQHSPAMAGAHYPLHCLHSAAAAAAAGSHHHHHHQHHHHGSPYASGGGNSYNHRSLAAYPYMSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 44044 - protein, 293 aa, Homo sapiens
MMTMTTMADGLEGQDSSKSAFMEFGQQQQQQQQQQQQQQQQQQQPPPPPPPPPQPHSQQSSPAMAGAHYPLHCLHSAAAAAAAGSHHHHHHQHHHHGSPYASGGGNSYNHRSLAAYPYMSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 44045 - protein, 3027 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLEQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYRAEKNTRMTQFFGHNFEDERWRKAALKNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNEIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPYYLTGAQDGSVRMFEWGHSQQITCFRSGGNSRVTRMRFNYQGNKFGIVDADGYLSLYQTNWKCCPVTGSMPKPYLTWQCHNKTANDFVFVSSSSLIATAGLSTDNRNVCLWDTLVAPANSLVHAFTCHDSGATVLAYAPKHQLLISGGRKGFTYVFDLCQRQQRQLFQSHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 44046 - protein, 589 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLK

SEQ ID NO: 44047 - protein, 3048 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLEQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYRAEKNTRMTQFFGHNFEDERWRKAALKNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNESLEDNSETIKNSMMEEPNINKIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPYYLTGAQDGSVRMFEWGHSQQITCFRSGGNSRVTRMRFNYQGNKFGIVDADGYLSLYQTNWKCCPVTGSMPKPYLTWQCHNKTANDFVFVSSSSLIATAGLSTDNRNVCLWDTLVAPANSLVHAFTCHDSGATVLAYAPKHQLLISGGRKGFTYVFDLCQRQQRQLFQSHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 44048 - protein, 3036 aa, Homo sapiens
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSSRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 44049 - protein, 602 aa, Homo sapiens
MWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSESIEEHVEQVNQNCIAEDCHIKVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 44050 - protein, 2400 aa, Homo sapiens
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 44051 - protein, 3037 aa, Homo sapiens
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSSRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 44052 - protein, 1616 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 44053 - protein, 1632 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 44054 - protein, 1619 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEGGSSGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 44055 - protein, 1484 aa, Homo sapiens
GSCHSPASASQVAGTTAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 44056 - protein, 912 aa, Homo sapiens
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 44057 - protein, 912 aa, Homo sapiens; identical to SEQ ID NO: 44056

SEQ ID NO: 44058 - protein, 723 aa, Homo sapiens
MGILERVVRRNGRVDRSLKDECDTAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 44059 - protein, 689 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 44060 - protein, 166 aa, Homo sapiens
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGESSAPGAASSGPTSIP

SEQ ID NO: 44061 - protein, 845 aa, Homo sapiens
MEPSPEPPSLESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 44062 - protein, 853 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 44063 - protein, 792 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKDLWLSCALHRRVQHGPWCPPEAAGKVLERACHPTPLRPSEGLLCM

SEQ ID NO: 44064 - protein, 770 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 44065 - protein, 833 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 44066 - protein, 332 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPASLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALERTRLEDAQLTTQPPLTTAPHPSASRQIAITTAKTEGMKIRAENKWLQMLPTTRAAWKEKPRVLPPSL

SEQ ID NO: 44067 - protein, 728 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPASLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 44068 - protein, 694 aa, Homo sapiens
MKGDTRHLNGEEDAGGREDSILVNGACSDQSSDSPPILEAIRTPEIRGRRSSSRLSKREVSSLLSYTQSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 44069 - protein, 566 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRHLCGDSVKPTHPSCLALCLWGRMGDSCHRGQWHAGHSQLSF

SEQ ID NO: 44070 - protein, 387 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 44071 - protein, 386 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 44072 - protein, 1040 aa, Homo sapiens
MLEDISEEDIWEYKSKRKPKRVDPNNGSKNILKSVEKATDGKYQSKRSRNRKRAAEAKEVKDHEVPLGNAGCQTSVASSQNSSCGDGIQQTQDKETTPGKLCRTQKSQHVSPKIRPVYDGYCPNCQMPFSSLIGQTPRWHVFECLDSPPRSETECPDGLLCTSTIPFHYKRYTHFLLAQSRAGDHPFSSPSPASGGSFSETKSGVLCSLEERWSSYQNQTDNSVSNDPLLMTQYFKKSPSLTEASEKISTHIQTSQQALQFTDFVENDKLVGVALRLANNSEHINLPLPENDFSDCEISYSPLQSDEDTHDIDEKPDDSQEQLFFTESSKDGSLEEDDDSCGFFKKRHGPLLKDQDESCPKVNSFLTRDKYDEGLYRFNSLNDLSQPISQNNESTLPYDLACTGGDFVLFPPALAGKLAASVHQATKAKPDEPEFHSAQSNKQKQVIEESSVYNQVSLPLVKSLMLKPFESQVEGYLSSQPTQNTIRKLSSENLNAKNNTNSACFCRKALEGVPVGKATILNTENLSSTPAPKYLKILPSGLKYNARHPSTKVMKQMDIGVYFGLPPKRKEEKLLGESALEGINLNPVPSPNQKRSSQCKRKAEKSLSDLEFDASTLHESQLSVELSSERSQRQKKRCRKSNSLQEGACQKRSDHLINTESEAVNLSKVKVFTKSAHGGLQRGNKKIPESSNVGGSRKKTCPFYKKIPGTGFTVDAFQYGVVEGCTAYFLTHFHSDHYAGLSKHFTFPVYCSEITGNLLKNKLHVQEQYIHPLPLDTECIVNGVKVVLLDANHCPGAVMILFYLPNGTVILHTGDFRADPSMERSLLADQKVHMLYLDTTYCSPEYTFPSQQEVIRFAINTAFEAVTLNPHALVVCGTYSIGKEKVFLAIADVLGSKVGMSQEKYKTLQCLNIPEINSLITTDMCSSLVHLLPMMQINFKGLQSHLKKCGGKYNQILAFRPTGWTHSNKFTRIADVIPQTKGNISIYGIPYSEHSSYLEMKRFVQWLKPQKIIPTVNVGTWKSRSTMEKYFREWKLEAGY

SEQ ID NO: 44073 - protein, 1040 aa, Homo sapiens; identical to SEQ ID NO: 44072

SEQ ID NO: 44074 - protein, 270 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIDGVLLCGPG

SEQ ID NO: 44075 - protein, 274 aa, Homo sapiens
MCLLLDRHLLFVPLVADVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 44076 - protein, 103 aa, Homo sapiens
MLQKPKSVKLRALRSPRKFGVAGRSCQEVLRKGCLRFQLPERGSRLCLYEDGTELTEDYFPSVPDNAELVLLTLGQAWQGWFRHVSQDSLTLLGSSCPPALVS

SEQ ID NO: 44077 - protein, 274 aa, Homo sapiens; identical to SEQ ID NO: 44075

SEQ ID NO: 44078 - protein, 338 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 44079 - protein, 116 aa, Homo sapiens
MLQKPKSVKLRALRSPRKFGVAGRSCQEVLRKGCLRFQLPERGSRLCLYEDGTELTEDYFPSVPDNAELVLLTLGQAWQGSVGVRARTKTRDTSSLSPGDCQALGNGGRCGQRLFL

SEQ ID NO: 44080 - protein, 86 aa, Homo sapiens [sequence omitted]

SEQ ID NO: 44081 - protein, 82 aa, Homo sapiens
MLQKPKSVKLRALRSPRKFGVAGRSCQEVLRKGCLRFQLPERGSRLCLYEDGTELTEDYFPSVPDNAELVLLTLGQAWQGCE

SEQ ID NO: 44082 - protein, 270 aa, Homo sapiens; identical to SEQ ID NO: 44074

SEQ ID NO: 44083 - protein, 1060 aa, Homo sapiens
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 44084 - protein, 822 aa, Homo sapiens
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 44085 - protein, 1146 aa, Homo sapiens
MKTPCIPSPKQGSKGRGQSPAAQVRGPTWNAPAREGRPGAGHLGHLRVGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 44086 - protein, 238 aa, Homo sapiens
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPMIVCASLISITKLEWNPREKDYVYHVVSAICEWTVAFGFIFYFLTFIQDFQSVTLRISTEINGDI

SEQ ID NO: 44087 - protein, 266 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 44088 - protein, 266 aa, Homo sapiens; identical to SEQ ID NO: 44087

SEQ ID NO: 44089 - protein, 232 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 44090 - protein, 193 aa, Homo sapiens
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLVKKKLYSLIGTTVIEGS

SEQ ID NO: 44091 - protein, 177 aa, Homo sapiens
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLV

SEQ ID NO: 44092 - protein, 128 aa, Homo sapiens
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDS

SEQ ID NO: 44093 - protein, 412 aa, Homo sapiens
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 44094 - protein, 480 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 44095 - protein, 453 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 44096 - protein, 300 aa, Homo sapiens
MAEPQAERPRLCVFPDLLRPPSAADIETWCQPYRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 44097 - protein, 340 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 44098 - protein, 240 aa, Homo sapiens
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 44099 - protein, 409 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 44100 - protein, 409 aa, Homo sapiens; identical to SEQ ID NO: 44099

SEQ ID NO: 44101 - protein, 375 aa, Homo sapiens
MESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 44102 - protein, 324 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 44103 - protein, 277 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 44104 - protein, 228 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVT

SEQ ID NO: 44105 - protein, 148 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHS

SEQ ID NO: 44106 - protein, 122 aa, Homo sapiens
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGP

SEQ ID NO: 44107 - protein, 326 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 44108 - protein, 125 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGN

SEQ ID NO: 44109 - protein, 228 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLT

SEQ ID NO: 44110 - protein, 215 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKWLMAEKSLQRELSRTVKKE

SEQ ID NO: 44111 - protein, 241 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 44112 - protein, 66 aa, Homo sapiens
MVDYYEVLGVQRHASPEDIKKAYRKLALKWHPDKNPENKEEAERKFKQVAEAYEVLSDAKKRDIYD

SEQ ID NO: 44113 - protein, 45 aa, Homo sapiens
MVDYYEVLGVQRHASPEDIKKAYRKLALKWHPDKNPENKEEAERK

SEQ ID NO: 44114 - protein, 146 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSG

SEQ ID NO: 44115 - protein, 211 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 44116 - protein, 277 aa, Homo sapiens
MPHPRILKRPKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 44117 - protein, 98 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDD

SEQ ID NO: 44118 - protein, 223 aa, Homo sapiens
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 44119 - protein, 793 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 44120 - protein, 747 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDHL

SEQ ID NO: 44121 - protein, 177 aa, Homo sapiens [sequence omitted]

SEQ ID NO: 44122 - protein, 332 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILLLH

SEQ ID NO: 44123 - protein, 2243 aa, Homo sapiens
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLATPPNGNFADAVFRFNANISYSGVLHAVTQDGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNGRTLFKLFQHPSMAIIKGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAKEVEKFAKEKVDLVLMHWRDRMGIAQKENINQKPVVLRKRRQRIKIEANWDLFYYRFGQDHARSNLIWNFKTREELKDTLESEMRAFNIDRELGSANVISWNHHEFEVKYECLAEEIKIGDYYLRLLLEEDENEESGSIKRSYEFFNELYHRFLLTPKVNMKCLCLQALAIVYGRCHEEIGPFTDTRYIIGMLERCTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 44124 - protein, 890 aa, Homo sapiens
MYQISKNSGWARSREYNFNLKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 44125 - protein, 116 aa, Homo sapiens
MASTVVAVGLTIAAAGFAGRYVLQAMKHMEPQVKQVFQSLPKSAFSGGYYRGGFEPKMTKREAALILGVSPTANKGKIRDAHRRIMLLNHPDKGGSPYIAAKINEAKDLLEGQAKK

SEQ ID NO: 44126 - protein, 568 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 44127 - protein, 621 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 44128 - protein, 202 aa, Homo sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRVSISKKKKKKR

SEQ ID NO: 44129 - protein, 273 aa, Homo sapiens
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 44130 - protein, 202 aa, Homo sapiens
MAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 44131 - protein, 504 aa, Homo sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 44132 - protein, 198 aa, Homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 44133 - protein, 167 aa, Homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDERGGH

SEQ ID NO: 44134 - protein, 199 aa, Homo sapiens
MACNIPNQRQRTLSTTGEALYEILGLHKGASNEEIKKTYRKLALKHHPDKNPDDPAATEKFKEINNAHAILTDISKRSIYDKYGSLGLYVAEQFGDENVNTYFMLSSWWAKALFVIVGLLTGCYFCCCLCCCCNCCCGHCRPESSVPEEDFYVSPEDLEEQIKSDMEKDVDFPVFLQPTNANEKTQLIKEGSRSYCTDS

SEQ ID NO: 44135 - protein, 189 aa, Homo sapiens
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 44136 - protein, 189 aa, Homo sapiens; identical to SEQ ID NO: 44135

SEQ ID NO: 44137 - protein, 900 aa, Homo sapiens
MEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 44138 - protein, 970 aa, Homo sapiens
MSLLGSYRKKTSNDGYESLQLVDSNGDLSAGSGGVGGKQRVNAGAAARSPARQPPDRASTMDSSGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 44139 - protein, 913 aa, Homo sapiens
MKDSENKGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 44140 - protein, 260 aa, Homo sapiens
MGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQSRQKDRQKEMDNFLAQMEAKYCKSSKGGGKKSALKKEKK

SEQ ID NO: 44141 - protein, 342 aa, Homo sapiens
MLENSLYSPTWEGSQFWVTVQRTEAAERCGLHGSYVLRVEAERLTLLTVGAQSQILEPLLSWPYTLLRRYGRDKVMFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSLYSDPLDSTSAQAGEGVQRKKPLYWDLYEHAQQQLLKAKLTDPKEDPIYDEPEGLAPVPPQGLYDLPREPKDAWWCQARVKEEGYELPYNPATDDYAVPPPRSTKPLLAPKPQGPAFPEPGTATGSGIKSHNSALYSQVQKSGASGSWDCGLSRVGTDKTGVKSEGST

SEQ ID NO: 44142 - protein, 481 aa, Homo sapiens [sequence omitted]

SEQ ID NO: 44143 - protein, 412 aa, Homo sapiens
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRGILAVPPQLLADPLYDSIEETLPPRPDHIYDEPEGVAALSLYDSPQEPRGEAWRRQATADRDPAGLQHVQPAGQDFSASGWQPGTEYDNVVLKKGPK

SEQ ID NO: 44144 - protein, 258 aa, Homo sapiens
MRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRGILAVPPQLLADPLYDSIEETLPPRPDHIYDEPEGVAALSLYDSPQEPRGEAWRRQATADRDPAGLQHVQPAGQDFSASGWQPGTEYDNVVLKKGPK

SEQ ID NO: 44145 - protein, 330 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLLCSCSWRHPRSQPRTQASCLQGSDCPAPHRNSTSAAHTLGTS

SEQ ID NO: 44146 - protein, 496 aa, Homo sapiens
MTRGARLRSDARAQLNQLSLDGGTGSGQKGKCEEFPSSLSSVSPGLEAAALLLAVTMDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 44147 - protein, 228 aa, Homo sapiens
MDPLETPIKDGILYQQHVKFGKGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLLCSCSWRHPRSQPRTQASCLQGSDCPAPHRNSTSAAHTLGTS

SEQ ID NO: 44148 - protein, 144 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLV

SEQ ID NO: 44149 - protein, 156 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQ

SEQ ID NO: 44150 - protein, 43 aa, Homo sapiens
MDPLETPIKDGILYQQHVKFGKKCWRKVWALLYAGGPSGVARL

SEQ ID NO: 44151 - protein, 213 aa, Homo sapiens
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGS

SEQ ID NO: 44152 - protein, 13 aa, Homo sapiens
MDPLETPIKDGIL

SEQ ID NO: 44153 - protein, 85 aa, Homo sapiens
MDPLETPIKDGILYQQHVKFGKKCWRKVWALLYAGGPSGVARLESWEVRDGGLGAAGDRSAGPGRRGERRVIRLADCVSVLPADG

SEQ ID NO: 44154 - protein, 326 aa, Homo sapiens
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 44155 - protein, 306 aa, Homo sapiens [sequence omitted]

SEQ ID NO: 44156 - protein, 504 aa, Homo sapiens
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRCGYWAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKVNPPP

SEQ ID NO: 44157 - protein, 608 aa, Homo sapiens
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRCGYWAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKGAAASAPGPATAHSGSPGPVAVDSPGPERPRGESPTYVNIPVSPSSRKQLHYMGLELQEASEGVRGAGASLYAQIDIMATETAHRVGVRHARAREEQLSELEQRKAAPQ

SEQ ID NO: 44158 - protein, 255 aa, Homo sapiens
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRGWRLLPVLGRGGADQLPVRLHRPRHLPHQGPLWAAAGSTRPKSPGTLDCGGACGPGSPGNPTAGEAAEPPLTCGQAGQWRG

SEQ ID NO: 44159 - protein, 456 aa, Homo sapiens
MGYFRCARAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 44160 - protein, 419 aa, Homo sapiens
MGYFRCARAGSFGRRRKMEPSTAARAWALFWLLLPLLGAVCASGPRTLVLLDNLNVRETHSLFFRSLKDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 44161 - protein, 92 aa, Homo sapiens
MTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 44162 - protein, 122 aa, Homo sapiens
MLSVGGLRLSLVRFSFLLLRGALLPSLAVTMTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 44163 - protein, 92 aa, Homo sapiens; identical to SEQ ID NO: 44161

SEQ ID NO: 44164 - protein, 396 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMHSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 44165 - protein, 396 aa, Homo sapiens; identical to SEQ ID NO: 44164

SEQ ID NO: 44166 - protein, 396 aa, Homo sapiens; identical to SEQ ID NO: 44164

SEQ ID NO: 44167 - protein, 396 aa, Homo sapiens; identical to SEQ ID NO: 44164

SEQ ID NO: 44168 - protein, 396 aa, Homo sapiens; identical to SEQ ID NO: 44164

SEQ ID NO: 44169 - protein, 396 aa, Homo sapiens; identical to SEQ ID NO: 44164

SEQ ID NO: 44170 - protein, 396 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMQSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 44171 - protein, 396 aa, Homo sapiens; identical to SEQ ID NO: 44164

SEQ ID NO: 44172 - protein, 396 aa, Homo sapiens; identical to SEQ ID NO: 44164

SEQ ID NO: 44173 - protein, 396 aa, Homo sapiens; identical to SEQ ID NO: 44164

SEQ ID NO: 44174 - protein, 396 aa, Homo sapiens; identical to SEQ ID NO: 44164

SEQ ID NO: 44175 - protein, 396 aa, Homo sapiens; identical to SEQ ID NO: 44170

SEQ ID NO: 44176 - protein, 396 aa, Homo sapiens; identical to SEQ ID NO: 44164

SEQ ID NO: 44177 - protein, 396 aa, Homo sapiens; identical to SEQ ID NO: 44164

SEQ ID NO: 44178 - protein, 396 aa, Homo sapiens; identical to SEQ ID NO: 44164

SEQ ID NO: 44179 - protein, 396 aa, Homo sapiens; identical to SEQ ID NO: 44164

SEQ ID NO: 44180 - protein, 396 aa, Homo sapiens; identical to SEQ ID NO: 44164

SEQ ID NO: 44181 - protein, 396 aa, Homo sapiens; identical to SEQ ID NO: 44170

SEQ ID NO: 44182 - protein, 480 aa, Homo sapiens
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 44183 - protein, 31 aa, Homo sapiens
MNASEFRRRGKEMVDYMANYMEGIEGRQVYP

SEQ ID NO: 44184 - protein, 16 aa, Homo sapiens
MNASEFRRRGKEMVDY

SEQ ID NO: 44185 - protein, 480 aa, Homo sapiens; identical to SEQ ID NO: 44182

SEQ ID NO: 44186 - protein, 338 aa, Homo sapiens
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWSRQPVRMLRLKKTCLVSAVVRRS

SEQ ID NO: 44187 - protein, 402 aa, Homo sapiens
MNASEFRRRGKEMVDYMANYMEGIEGRQVYPDVEPGYLRPLIPAAAPQEPDTFEDIINDVEKIIMPGGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 44188 - protein, 387 aa, Homo sapiens
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 44189 - protein, 244 aa, Homo sapiens
MREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAK

SEQ ID NO: 44190 - protein, 617 aa, Homo sapiens
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 44191 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 44192 - protein, 446 aa, Homo sapiens; identical to SEQ ID NO: 44191

SEQ ID NO: 44193 - protein, 414 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 44194 - protein, 445 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVVQEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 44195 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 44196 - protein, 445 aa, Homo sapiens; identical to SEQ ID NO: 44194

SEQ ID NO: 44197 - protein, 7 aa, Homo sapiens
MDPLNLS

SEQ ID NO: 44198 - protein, 443 aa, Homo sapiens; identical to SEQ ID NO: 44195

SEQ ID NO: 44199 - protein, 177 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNA

SEQ ID NO: 44200 - protein, 442 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 44201 - protein, 342 aa, Homo sapiens
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSATSGEEGNPNGGHCAWGLHCLLAALLLDPCSQYPLPDMPRVPRALQCHDMAGLRE

SEQ ID NO: 44202 - protein, 367 aa, Homo sapiens
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLMPLREKKATQMVAIVLGAFIVCWLPFFLTHVLNTHCQTCHVSPELYSATTWLGYVNSALNPVIYTTFNIEFRKAFLKILSC

SEQ ID NO: 44203 - protein, 400 aa, Homo sapiens
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 44204 - protein, 400 aa, Homo sapiens; identical to SEQ ID NO: 44203

SEQ ID NO: 44205 - protein, 400 aa, Homo sapiens; identical to SEQ ID NO: 44203

SEQ ID NO: 44206 - protein, 419 aa, Homo sapiens
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 44207 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 44208 - protein, 145 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQ

SEQ ID NO: 44209 - protein, 2298 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSCHTDSENTSSFSSPSHDLQELSNEENCCAPIPMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAEEDLYDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTNKVNRTKVSVPDANGPSVGEIPQSELILYLSACKFLDTALSFPPDKMPLFQIYRWAFIPEVDTEGPAFLSDVEENHQECKPHTVRILELLKLKFGEISSSDEITMKSEFPLLRQHSVSSIRQLMPFFMTLNGAFKTQRQLPADSPGTPFLDFPVTDSPRILKQLEECIEYDFLEHPEC

SEQ ID NO: 44210 - protein, 263 aa, Homo sapiens
MFYFHCPPQLEGTATFGNHSSGDFDDGFLRRKQRRNRTTFTLQQLEALEAVFAQTHYPDVFTREELAMKINLTEARVQVWFQNRRAKWRKTERGASDQEPGAKEPMAEVTPPPVRNINSPPPGDQARSKKEALEAQQSLGRTVGPAGPFFPSCLPGTLLNTATYAQALSHVASLKGGPLCSCCVPDPMGLSFLPTYGCQSNRTASVATLRMKAREHSEAVLQSANLLPSTSSSPGPVAKPAPPDGSQEKTSPTKEQSEAEKSV

SEQ ID NO: 44211 - protein, 268 aa, Homo sapiens
MVLMSCDQRLISLLLVGTATFGNHSSGDFDDGFLRRKQRRNRTTFTLQQLEALEAVFAQTHYPDVFTREELAMKINLTEARVQVWFQNRRAKWRKTERGASDQEPGAKEPMAEVTPPPVRNINSPPPGDQARSKKEALEAQQSLGRTVGPAGPFFPSCLPGTLLNTATYAQALSHVASLKGGPLCSCCVPDPMGLSFLPTYGCQSNRTASVATLRMKAREHSEAVLQSANLLPSTSSSPGPVAKPAPPDGSQEKTSPTKEQSEAEKSV

SEQ ID NO: 44212 - protein, 1740 aa, Homo sapiens
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGAGGVFNHAVPSASAHPFGARVGRGAACGSATLGPSPLQAAASASASSFQAPASVETRPPPPPPPPPPPLPPPAHLGRSPAGPPVLHAPPPPNAALPPPPTLLASNPEPALLQSLASLPPNQAFLPPTSAASLPPANASLSIKLTSLPHKGARPSFTVHHQPLPRLALAQAAPGIPQASATGPSAVWVSLGMPPPYAAHLSGVKPR

SEQ ID NO: 44213 - protein, 1537 aa, Homo sapiens
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 44214 - protein, 400 aa, Homo sapiens
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 44215 - protein, 308 aa, Homo sapiens [sequence omitted]

SEQ ID NO: 44216 - protein, 308 aa, Homo sapiens [sequence omitted]

SEQ ID NO: 44217 - protein, 424 aa, Homo sapiens
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 44218 - protein, 485 aa, Homo sapiens
MKGWSLPACGPLQGRLAGWLAVRAGLLAAPAAVHSPAEVHGSPPASLCPRPSVKFRPGLTAMALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 44219 - protein, 441 aa, Homo sapiens
MKTLPLHSHCTEMQRLLPKLEMLTLGSSFCSLQGEFCQAMDSFTTVSHVGMCEETDASFNVFSPKFQFDRSHCQSLRFHQNMELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 44220 - protein, 365 aa, Homo sapiens
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKDLYLPLSLDDSDSLGDSM

SEQ ID NO: 44221 - protein, 365 aa, Homo sapiens; identical to SEQ ID NO: 44220

SEQ ID NO: 44222 - protein, 438 aa, Homo sapiens
  MOD_RES (1)..(1): Any amino acid
XCTEMQRLLPKLEMLTLGSSFCSLQGEFCQAMDSFTTVSHVGMCEETDASFNVFSPKFQFDRSHCQSLRFHQNMELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKDLYLPLSLDDSDSLGDSM

SEQ ID NO: 44223 - protein, 360 aa, Homo sapiens
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 44224 - protein, 113 aa, Homo sapiens
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKI

SEQ ID NO: 44225 - protein, 360 aa, Homo sapiens; identical to SEQ ID NO: 44223

SEQ ID NO: 44226 - protein, 354 aa, Homo sapiens
MAKTGAEDHREALSQSSLSLLTEAMEVLQQSSPEGTLDGNTVNPIYKYILNDLPREFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTVPTITLLLEECTEKLNLNMAARRVFLADGKEALEPEDIPHEADVYVSTGEPFLNPFKKIKDHLLLIKKVTWTMNGLMLPTDIKRRKTKPVLSIRMKKLTERTSVRILFFKNGMGQDGHEITVGKETMKKVLDTCTIRMNLNLPARYFYDLYGRKIEDISKGKH

SEQ ID NO: 44227 - protein, 229 aa, Homo sapiens
MKMWNNWGWCGGRRRGCTKILSTKKGIQMSIKNKHLIVIPAFSHTMSQLDFDFHCVFVSIDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 44228 - protein, 476 aa, Homo sapiens
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYSELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 44229 - protein, 88 aa, Homo sapiens
  MOD_RES (1)..(1): Any amino acid
XVVIHEKKVSSFEVFLKEVTGGVQAPFGAVRNIYTPRTGHRIRKLDQIQSGGNYVAGGQEAFKKLNYLDIGEIKKRPMEVVNTELHVL

SEQ ID NO: 44230 - protein, 120 aa, Homo sapiens
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTELHVL

SEQ ID NO: 44231 - protein, 648 aa, Homo sapiens
MKKPICKTTEPYAPVRLRVLQNGEKNKNRSVTILGPDISPGRKTQCTEILNLPSAARRLYNEKGKEIFALKDLQRDELVYVSCGELWINPDLSIAQQKKQIFLRNLESDIAKIQIFCSTHKIEALVLEVQSDIVSGSKLAVHKPVAIFGEEKQVTEPEEKQMQEDPLTTENASSEILDSHVRAHLRMKACHTLPRYAWQETSHDFDEDDSLPKKTEKGLFENVEPQKKHSCSPKHSKLHKHCHQQFEYRDGQIISHAAPQLVLGVQGPNLRSGMEVVLVEKKSDGSHQRWIHQEDSRTFHLVSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVEKNPRMKVKNRLFAKSVTSDSLDGIDKSLLTLILRNPIAIWVSCGEPFLPPNESRKIRETELAKKGQNFG

SEQ ID NO: 44232 - protein, 454 aa, Homo sapiens
MKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVESMEENPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISEVSLLYLKTWIFIWSRKVFFYFLITA

SEQ ID NO: 44233 - protein, 729 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 44234 - protein, 740 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 44235 - protein, 363 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRDLYRPLSSDDLDSVGDSV

SEQ ID NO: 44236 - protein, 433 aa, Homo sapiens
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 44237 - protein, 421 aa, Homo sapiens
LSLIKFNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 44238 - protein, 619 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMASQKMNISCQ

SEQ ID NO: 44239 - protein, 766 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKQISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 44240 - protein, 783 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVKRGGHYSSAYSTAKSPVNGTPSSQLSTPKSTKSSSSSPTSPGSFRGLKQISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 44241 - protein, 765 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 44242 - protein, 648 aa, Homo sapiens
MGKEPLTLKSIQVAVEELYPNKARALTLAQHSRAPSPRLRSRLFSKALKGDHRCGETETPKSCSEVAGCKAAMRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 44243 - protein, 373 aa, Homo sapiens
MPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVALRRQQAQEEELGISHPIPLPSAAELLVKRENNGSNPCLMTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 44244 - protein, 174 aa, Homo sapiens
MPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVGAGVREPGFSLSFFFFFFFRWSLARLPRLQCSGAILAHCNSASRVQAILLPQPPK

SEQ ID NO: 44245 - protein, 226 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEVLLGLFYSYYVYIMNHL

SEQ ID NO: 44246 - protein, 561 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 44247 - protein, 561 aa, Homo sapiens; identical to SEQ ID NO: 44246

SEQ ID NO: 44248 - protein, 561 aa, Homo sapiens; identical to SEQ ID NO: 44246

SEQ ID NO: 44249 - protein, 226 aa, Homo sapiens; identical to SEQ ID NO: 44245

SEQ ID NO: 44250 - protein, 226 aa, Homo sapiens; identical to SEQ ID NO: 44245

SEQ ID NO: 44251 - protein, 2012 aa, Homo sapiens
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 44252 - protein, 2113 aa, Homo sapiens
MTGAGEPRREEPPPQPSAGLRSRESGAPSAGGWERAERGRGAAARPATGPPPRRIGPLYGMWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 44253 - protein, 1820 aa, Homo sapiens
MLPYWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 44254 - protein, 253 aa, Homo sapiens
MEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRTSQLNKLCHHAATNGRAGGGELGSRHQKRGAAAGARGDVRVCRYARDATEIQNIQIADGDVCRGLSVPIYMVFPRLFTCPTLETTNFKVEFEVNIVVLLHPDHLITENFPLKLCRI

SEQ ID NO: 44255 - protein, 297 aa, Homo sapiens
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 44256 - protein, 172 aa, Homo sapiens
MGTALDIKIKRANKVYHAGPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 44257 - protein, 270 aa, Homo sapiens
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 44258 - protein, 220 aa, Homo sapiens
MGTALDIKIKRANKVYHAGEVLSGVVVISSKDSVQHQGVSLTMEGTVNLQLSAKSVGVFEAFYNSVKPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 44259 - protein, 118 aa, Homo sapiens
MSLIILTRDDEPRIFTPDSDAASPALHSTSPLPDPASASPLHREEKILPKVCNIVSCLSFSLPASPTDSGLASPTIITREGQQFWAKCLIWKYQLYLHGLHKKSDGRRDKQISASPST

SEQ ID NO: 44260 - protein, 190 aa, Homo sapiens
MEPEAAAGARKARGRGCHCPGDAPWRPPPPRGPESPAPWRPWIQTPGDAELTRTGRPLEPRADQHTFGSKGAFGFQHPVRVYLPMSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 44261 - protein, 97 aa, Homo sapiens
MKEPGPNFVTVRKGLHSFKMAFVKHLLLFLSPRLECSGSITDHCSLHLPVQEILMSQPPEQLGLQTNLGNQESSGMMKLFMPRPKVLAQYESIQFMP

SEQ ID NO: 44262 - protein, 91 aa, Homo sapiens
MKEPGPNFVTVRKGLHSFKMAFVKHLLLECSGSITDHCSLHLPVQEILMSQPPEQLGLQTNLGNQESSGMMKLFMPRPKVLAQYESIQFMP

SEQ ID NO: 44263 - protein, 176 aa, Homo sapiens
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 44264 - protein, 176 aa, Homo sapiens; identical to SEQ ID NO: 44263

SEQ ID NO: 44265 - protein, 489 aa, Homo sapiens
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 44266 - protein, 261 aa, Homo sapiens
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 44267 - protein, 354 aa, Homo sapiens
MLWLWLHDWRRRQGQRCSFWVTQPTAEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 44268 - protein, 57 aa, Homo sapiens
MAVFHDEVEIEDFQYDEDSETYFYPCPCGDNFSITKDQFVCGETVPAPSANKELVKC

SEQ ID NO: 44269 - protein, 82 aa, Homo sapiens
MAVFHDEVEIEDFQYDEDSETYFYPCPCGDNFSITKEDLENGEDVATCPSCSLIIKVIYDKDQFVCGETVPAPSANKELVKC

SEQ ID NO: 44270 - protein, 284 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPVTEETLCVGLARVGADDQKIAAGTLRQMCTVDLGEPLHSLIITGGSIHPMEMEMLSLFSIPENSSESQSINGL

SEQ ID NO: 44271 - protein, 285 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 44272 - protein, 234 aa, Homo sapiens
MLYLIGLGLGDAKDITVKGLEVVRRCSRVYLEAYTSVLTVGKEALEEFYGRKLVVADREEVEQEADNILKDADISDVAFLVVGDPTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 44273 - protein, 46 aa, Homo sapiens
MCTVDLGEPLHSLIITGGSIHPMEMEMLSLFSIPENSSESQSINGL

SEQ ID NO: 44274 - protein, 284 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQYISLERQFLLFFGQTLGPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 44275 - protein, 285 aa, Homo sapiens; identical to SEQ ID NO: 44271

SEQ ID NO: 44276 - protein, 675 aa, Homo sapiens
MEGRPPPEGRPPPRPRTGRAPRGRRRAVFAAVLHWSHITHLFENDRHFSHLSTLEREMAFRTEMGLYYSYFKTIVEAPSFLNGVWMIMNDKLTEYPLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPGAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 44277 - protein, 85 aa, Homo sapiens
MYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 44278 - protein, 758 aa, Homo sapiens
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 44279 - protein, 205 aa, Homo sapiens
MRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 44280 - protein, 90 aa, Homo sapiens
MRKQGVSSKRLQSSGRSQSKGRRGASLAREPEVEEEMEKSALGGGKLPRGSWRSSPGRIQSLKERKGLELEVVAKTFLLGPFQFVRNSLA

SEQ ID NO: 44281 - protein, 542 aa, Homo sapiens
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKNQKS

SEQ ID NO: 44282 - protein, 716 aa, Homo sapiens
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKFWPGMMDELSELREFYDPDTVELMNWINSNTPRKAVFAGSMQLLAGVKLCTGRTLTNHPHYEDSSLRERTRAVYQIYAKRAPEEVHALLRSFGTDYVILEDSICYERRHRRGCRLRDLLDIANGHMMDGPGENDPDLKPADHPRFCEEIKRNLPPYVAYFTRVFQNKTFHVYKLSRNK

SEQ ID NO: 44283 - protein, 113 aa, Homo sapiens
MMSIRQRREIRATEVSEDFPAQEENVKLENKLPSGCTSRRLWKILSLTIGGTLPFALDFLHLSTLPRYMKMIYGFLILRKWSEKSHSEQSVACITPTTSRCCRLQPSCKVFMA

SEQ ID NO: 44284 - protein, 716 aa, Homo sapiens; identical to SEQ ID NO: 44282

SEQ ID NO: 44285 - protein, 723 aa, Homo sapiens
MAEEEGPPVELRQRKKPKSSENKESAKEEKISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKVYEVYKIYIFSLFLGYLLQFENPALLVSPLLSLVAALMLAKCLQLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILLGSLAMVIEGLKYIWIPYVCMLAAFGVCSPELWMTLFKWLRLRTVHPILLALILSMAVPTIIGLSLWKEFFPRLMTELMELQEFYDPDTVELMTWIKRQAPVAAVFAGSPQLMGAIKLCTGWMVTSLPLYNDDDLLKRNENIYQIYSKRSAEDIYKILTSYKANYLIVEDAICNEVGPMRGCRVKDLLDIANGHMVCEEGDKLTYSKYGRFCHEVKINYSPYVNYFTRVYWNRSYFVYKINTVISFQS

SEQ ID NO: 44286 - protein, 99 aa, Homo sapiens
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 44287 - protein, 99 aa, Homo sapiens; identical to SEQ ID NO: 44286

SEQ ID NO: 44288 - protein, 651 aa, Homo sapiens
MAGHPWHGTAALASSQAWRDGRERQALVSCRALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 44289 - protein, 649 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 44290 - protein, 381 aa, Homo sapiens
MKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 44291 - protein, 317 aa, Homo sapiens
MAGVSFSGHRLELLAAYEEVIREESAADWALYTYEDGSDDLKLAASGGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRP

SEQ ID NO: 44292 - protein, 124 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDI

SEQ ID NO: 44293 - protein, 1299 aa, Homo sapiens
HRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 44294 - protein, 1374 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 44295 - protein, 1185 aa, Homo sapiens
HRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEWSIYLLSNCDCCLLRPSLVFLQTMNEVCSLK

SEQ ID NO: 44296 - protein, 1337 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 44297 - protein, 201 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSS

SEQ ID NO: 44298 - protein, 1374 aa, Homo sapiens; identical to SEQ ID NO: 44294

SEQ ID NO: 44299 - protein, 209 aa, Homo sapiens
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSGAEGDVSSEREP

SEQ ID NO: 44300 - protein, 280 aa, Homo sapiens
MGRAELLEGKMSTQDPSDLWSRSDGEAELLQDLGWYHGNLTRHAAEALLLSNGCDGSYLLRDSNETTGLYSLSVRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKTWKTRWFTLHRNELKYFKDQMSPEPIRILDLTECSAVQFDYSQERVNCFCLVFPFRTFYLCAKTGVEADEWIKILRWKLSQIRKQLNQGEGTIRSRSFIFK

SEQ ID NO: 44301 - protein, 1551 aa, Homo sapiens
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 44302 - protein, 1551 aa, Homo sapiens; identical to SEQ ID NO: 44301

SEQ ID NO: 44303 - protein, 1551 aa, Homo sapiens; identical to SEQ ID NO: 44301

SEQ ID NO: 44304 - protein, 43 aa, Homo sapiens
MGFCLALAWTLLVGAWTPLGAQNPISWEVQRFDGWYNNLMEHR

SEQ ID NO: 44305 - protein, 1197 aa, Homo sapiens
MWMHCCWAWPPRSQSERTMCWLKMCGVSLRLSLQVVNSWPLGRGSAGLPEPDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 44306 - protein, 1548 aa, Homo sapiens
MLRARPEALMLLGALLTGSLGPSGNQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 44307 - protein, 483 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYYRPRRLSLVPADVRGLAPAALSALPGALLAQAWRALLPGLRCPKAGKESRLGPPHSPWRFGPEGCEERWAEHTGDSPRPLRGRGTGRLWRWGSKERRACGVRAMLPRLVSNSGLKRPSCLDLPKCWDYRRDARAFFHLLEPTPCVTSRHTPLI

SEQ ID NO: 44308 - protein, 438 aa, Homo sapiens
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYYRPRRLSLVPADVRGLAPAALSALPGALLAQAWRALLPGLRCPKAGKESRLGPPHSPWRFGPEGCEERWAEHTGDSPRPLRGRGTGRLWRWGSKERRACGVRAMLPRLVSNSGLKRPSCLDLPKCWDYRRDARAFFHLLEPTPCVTSRHTPLI

SEQ ID NO: 44309 - protein, 77 aa, Homo sapiens
MATLGHTFPFYAGPKPTFPMDTTLASIIMIFLTALATFIVILPGIRGKTRLFWLLRVVTSLFIGAAILGTPVQQLNE

SEQ ID NO: 44310 - protein, 72 aa, Homo sapiens
MATLGHTFPFYAGPKPTFPMDTTLASIIMIFLTALATFIVILPGIRGKTRLFWLLRVVTSLFIGAAILAVNF

SEQ ID NO: 44311 - protein, 298 aa, Homo sapiens
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 44312 - protein, 13 aa, Homo sapiens
MATLGHTFPFYAG

SEQ ID NO: 44313 - protein, 298 aa, Homo sapiens; identical to SEQ ID NO: 44311

SEQ ID NO: 44314 - protein, 483 aa, Homo sapiens; identical to SEQ ID NO: 44307

SEQ ID NO: 44315 - protein, 72 aa, Homo sapiens
MATLGHTFPFYAGPKPTFPMDTTLASIIMIFLTALATFIVILPGIRGKTRLFWLLRVVTSLFIGAAILGTPV

SEQ ID NO: 44316 - protein, 16 aa, Homo sapiens
MATLGHTFPFYAGPKP

SEQ ID NO: 44317 - protein, 121 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLN

SEQ ID NO: 44318 - protein, 343 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 44319 - protein, 320 aa, Homo sapiens
MTLWNGVLPFYPQPRHAAGFSVPLLIVILVFLALAASFLLILPGIRGHSRWFWLVRVLLSLFIGAEIVAVHFSAEWFVGTVNTNTSYKAFSAARVTARVRLLVGLEGINITLTGTPVHQLNETIDYNEQFTWRLKENYAAEYANALEKGLPDPVLYLAEKFTPSSPCGLYHQYHLAGHYASATLWVAFCFWLLSNVLLSTPAPLYGGLALLTTGAFALFGVFALASISSVPLCPLRLGSSALTTQYGAAFWVTLATGVLCLFLGGAVVSLQYVRPSALRTLLDQSAKDCSQERGGSPLILGDPLHKQAALPDLKCITTNL

SEQ ID NO: 44320 - protein, 588 aa, Homo sapiens
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 44321 - protein, 884 aa, Homo sapiens
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGARPERLPVFDEECWQLMEACWDGDPLKRPLLGIVQPMLQGIMNRLCKSNSEQPNRGLDDST

SEQ ID NO: 44322 - protein, 929 aa, Homo sapiens
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 44323 - protein, 367 aa, Homo sapiens
MVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 44324 - protein, 302 aa, Homo sapiens
MVMEVGTLDAGGLRALLGERAAQCLLLDCRSFFAFNAGHIAGSVNVRFSAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 44325 - protein, 340 aa, Homo sapiens
MVMEVGTLDAGGLRALLGERAAQCLLLDCRSFFAFNAGHIAGSVNVRFSTIVRRRAKGAMGLEHIVPNAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 44326 - protein, 377 aa, Homo sapiens
MRNSETLERGVGGCRVFSCLGSYPGIEGAGLALLADLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 44327 - protein, 226 aa, Homo sapiens
MSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRRSLALSPRLECSGTISTHSKFCFPGSRRSPASASQVAGTTGARHHARLIFCIFSRDVVSPC

SEQ ID NO: 44328 - protein, 273 aa, Homo sapiens
MRNSETLERGVGGCRVFSCLGSYPGIEGAGLALLADLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRRSLALSPRLECSGTISTHSKFCFPGSRRSPASASQVAGTTGARHHARLIFCIFSRDVVSPC

SEQ ID NO: 44329 - protein, 198 aa, Homo sapiens
MDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 44330 - protein, 248 aa, Homo sapiens
MAETSLPELGGEDKATPCPSILELEELLRAGKSSCSRVDEVWPNLFIGDAMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 44331 - protein, 188 aa, Homo sapiens
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQS

SEQ ID NO: 44332 - protein, 291 aa, Homo sapiens
MGLCHFATLALILLVLLEALAQADTQKMVEAQRGVGPRACYSIWLLLAPTPPLSHCLQSPQKQHQVCGDRRLKASSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 44333 - protein, 198 aa, Homo sapiens; identical to SEQ ID NO: 44329

SEQ ID NO: 44334 - protein, 327 aa, Homo sapiens
MGLPQPRLPAPALQAGPATAGCRPELRGQSWSLLPAMGLCHFATLALILLVLLEALAQADTQKMVEAQRGVGPRACYSIWLLLAPTPPLSHCLQSPQKQHQVCGDRRLKASSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 44335 - protein, 198 aa, Homo sapiens
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKARRPVIRPNVGFWRQLIDYERQLFGKSTVKMVQTPYGIVPDVYEKESRHLMPYWGI

SEQ ID NO: 44336 - protein, 198 aa, Homo sapiens; identical to SEQ ID NO: 44335

SEQ ID NO: 44337 - protein, 314 aa, Homo sapiens
MGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 44338 - protein, 185 aa, Homo sapiens
MSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 44339 - protein, 144 aa, Homo sapiens
MSVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 44340 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 44341 - protein, 303 aa, Homo sapiens
MGRKVHSNGSQFAEHSRSPRRTGRDCKPVRAPSMALGVSQLAGRSRCLCSESQGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 44342 - protein, 384 aa, Homo sapiens
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACATHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 44343 - protein, 368 aa, Homo sapiens
MPCKSAEWLQEELEARGGASLLLLDCRPHELFESSHIETAINLAIPGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIDEARSKKCGVLVHCLAGISRSVTVTVAYLMQKMNLSLNDAYDFVKRKKSNISPNFNFMGQLLDFERTLGLSSPCDNHASSEQLYFSTPTNHNLFPLNTLEST

SEQ ID NO: 44344 - protein, 419 aa, Homo sapiens
MKNQLRGPPARAHMSTSGAAAAGGTRAGSEPGAGSGSGAGTGAGAATGAGAMPCKSAEWLQEELEARGGASLLLLDCRPHELFESSHIETAINLAIPGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIDEARSKKCGVLVHCLAGISRSVTVTVAYLMQKMNLSLNDAYDFVKRKKSNISPNFNFMGQLLDFERTLGLSSPCDNHASSEQLYFSTPTNHNLFPLNTLEST

SEQ ID NO: 44345 - protein, 625 aa, Homo sapiens
MAGDRLPRKVMDAKKLASLLRGGPGGPLVIDSRSFVEYNSWHVLSSVNICCSKLVKRRLQQGKVTIAELIQPAARSQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRFMRVPINDNYCEKLLPWLDKSIEFIDKAKLSSCQVIVHCLAGISRSATIAIAYIMKTMGMSSDDAYRFVKDRRPSISPNFNFLGQLLEYERSLKLLAALQGDPGTPSGTPEPPPSPAAGAPLPRLPPPTSESAATGNAAAREGGLSAGGEPPAPPTPPATSALQQGLRGLHLSSDRLQDTNRLKRSFSLDIKSAYAPSRRPDGPGPPDPGEAPKLCKLDSPSGAALGLSSPSPDSPDAAPEARPRPRRRPRPPAGSPARSPAHSLGLNFGDAARQTPRHGLSALSAPGLPGPGQPAGPGAWAPPLDSPGTPSPDGPWCFSPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 44346 - protein, 625 aa, Homo sapiens; identical to SEQ ID NO: 44345

SEQ ID NO: 44347 - protein, 541 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSVVEQHWMPGAFRMTVSFTLEVHDVPV

SEQ ID NO: 44348 - protein, 584 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVSSHVVHLLVSPAILRWSSTGCQVPLE

SEQ ID NO: 44349 - protein, 754 aa, Homo sapiens
MHTGGETSACKPSSVRLAPSFSFHAAGLQMAGQMPHSHQYSDRRQPNISDQQVSALSYSDQIQQPLTNQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 44350 - protein, 529 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGASAISCSSWLVRH

SEQ ID NO: 44351 - protein, 763 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 44352 - protein, 131 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKK

SEQ ID NO: 44353 - protein, 584 aa, Homo sapiens; identical to SEQ ID NO: 44348

SEQ ID NO: 44354 - protein, 46 aa, Homo sapiens
MHTGGETSACKPSSVRLAPSFSFHAAGLQMAGQMPHSHQYSDRRQP

SEQ ID NO: 44355 - protein, 535 aa, Homo sapiens
MFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 44356 - protein, 629 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 44357 - protein, 601 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 44358 - protein, 589 aa, Homo sapiens
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 44359 - protein, 94 aa, Homo sapiens
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKL

SEQ ID NO: 44360 - protein, 601 aa, Homo sapiens
MLTRKPSAAAPAAYPTGRGGDSAVRQLQASPGLGAGATRSGVGTGPPSPIALPPLRASNAAAAAHTIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 44361 - protein, 528 aa, Homo sapiens
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 44362 - protein, 156 aa, Homo sapiens
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIG

SEQ ID NO: 44363 - protein, 568 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 44364 - protein, 568 aa, Homo sapiens; identical to SEQ ID NO: 44363

SEQ ID NO: 44365 - protein, 588 aa, Homo sapiens
MGGTARGPGRKDAGPPGAGLPPQQRRLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 44366 - protein, 243 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQ

SEQ ID NO: 44367 - protein, 520 aa, Homo sapiens
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 44368 - protein, 520 aa, Homo sapiens; identical to SEQ ID NO: 44367

SEQ ID NO: 44369 - protein, 519 aa, Homo sapiens
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKDEITKETTEKTKDSPTKHVQHSGDQQDCLQHGADTVQLPQLVDAPKKSEAAVGAEVSMTSPGQSKNFSLKNTNVLPPIV

SEQ ID NO: 44370 - protein, 157 aa, Homo sapiens
MVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 44371 - protein, 336 aa, Homo sapiens
MGNCLHRAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 44372 - protein, 338 aa, Homo sapiens
MASSGYVLQAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 44373 - protein, 336 aa, Homo sapiens; identical to SEQ ID NO: 44371

SEQ ID NO: 44374 - protein, 155 aa, Homo sapiens
MASSGYVLQAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASL

SEQ ID NO: 44375 - protein, 336 aa, Homo sapiens; identical to SEQ ID NO: 44371

SEQ ID NO: 44376 - protein, 669 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 44377 - protein, 172 aa, Homo sapiens
MALIILLILTEDDGFNRSIHEVILKNITWYSERVLTEISLGSLLILVVIRTIQYNMTRTRDKYLHTNCLAALANMSAQFRSLHQYAAQRIISYTCRHLRRYVYVLDKLYFPHSHCSTLQHCFSTLSDNGEELLSLTCSHILRSYASSLFSLLSKKHNKVLEQATQSLRGSLS

SEQ ID NO: 44378 - protein, 479 aa, Homo sapiens
MGSNSSRIGDLPKNEYLKKLSGTESISENDPFWNQLLSFSFPAPTSSSELKLLEEATISVCRSLAGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 44379 - protein, 1278 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44380 - protein, 1261 aa, Homo sapiens
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKGRRVRTKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44381 - protein, 1271 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44382 - protein, 1144 aa, Homo sapiens
MMRQAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44383 - protein, 1256 aa, Homo sapiens
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44384 - protein, 890 aa, Homo sapiens
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQVGLDGWVEGVGRVSDQCGAFTSALGSCRSMGPPPAAPMSVCASHATSSSVP

SEQ ID NO: 44385 - protein, 186 aa, Homo sapiens
MLMGLLRPYILGERGTVMTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELS

SEQ ID NO: 44386 - protein, 1236 aa, Homo sapiens
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44387 - protein, 1139 aa, Homo sapiens
MMRQAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44388 - protein, 1253 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 44389 - protein, 406 aa, Homo sapiens
MADPKYADLPGIARNEPDVYETSDLPEDDQAEFDAFAQELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 44390 - protein, 378 aa, Homo sapiens
MYAQGTEDSRTLEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 44391 - protein, 314 aa, Homo sapiens
MLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 44392 - protein, 406 aa, Homo sapiens
MADPKYADLPGIARNEPDVYETSDLPEDDQAEFDATVQHLEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 44393 - protein, 401 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 44394 - protein, 186 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQDQCVEITEESKALLEEYNKTTMLLSKQFVQWDELLCQLEAATQVKPAEE

SEQ ID NO: 44395 - protein, 176 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQAPWGVGVRDEAGSLVEDVGFAQFLSVLHFGPTGPVCGNH

SEQ ID NO: 44396 - protein, 161 aa, Homo sapiens [sequence omitted]

SEQ ID NO: 44397 - protein, 104 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAERSSLSFPRLHSWSR

SEQ ID NO: 44398 - protein, 158 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAAVPEHAARLQRLAQIHIQQQDQCVEITEESKALLEEYNKTTMLLSKQFVQWDELLCQLEAATQVKPAEE

SEQ ID NO: 44399 - protein, 151 aa, Homo sapiens
QRLQARVEELERWVYGPGGARGSRKVADGLVKVQVALGNISSKRERVKILYKKIEDLIKYLDPEYIDRIAIPDASKLQFILAAVPEHAARLQRLAQIHIQQQDQCVEITEESKALLEEYNKTTMLLSKQFVQWDELLCQLEAATQVKPAEE

SEQ ID NO: 44400 - protein, 172 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAGNAGLHVYMHLRMWVVGEVKHRDGLSIQSSGGYKPWMLLSGIVAWFWVEDPMDPLVDIEYSIPLHQLQAMVPATVGASPVFYQ

SEQ ID NO: 44401 - protein, 182 aa, Homo sapiens
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGLFSGELPECTQELMIDVTKSYYQKFLPLTQV

SEQ ID NO: 44402 - protein, 84 aa, Homo sapiens
MELGELLYNKSEYIETASGNKVSRQSVLCGSQNIVLNGKNFVISVFLSPYIRCHSACRDRKRSDESVRLSVNNREWWGLVNWRM

SEQ ID NO: 44403 - protein, 190 aa, Homo sapiens
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 44404 - protein, 851 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 44405 - protein, 864 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 44406 - protein, 662 aa, Homo sapiens
MEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQITLQVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKVSVPFSCLLPGICSLAPAPARFSSKGPGDVLF

SEQ ID NO: 44407 - protein, 851 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 44408 - protein, 851 aa, Homo sapiens; identical to SEQ ID NO: 44407

SEQ ID NO: 44409 - protein, 864 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 44410 - protein, 396 aa, Homo sapiens
MERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 44411 - protein, 575 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLAEKKKKKKKK

SEQ ID NO: 44412 - protein, 699 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44413 - protein, 791 aa, Homo sapiens
MACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44414 - protein, 533 aa, Homo sapiens
MFHKKINGKQQEKKMTLLHGKTQDTFLKGWKQKNGVNFFTPKIRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44415 - protein, 710 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44416 - protein, 725 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44417 - protein, 736 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44418 - protein, 749 aa, Homo sapiens
MEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 44419 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQPETLVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 44420 - protein, 866 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 44421 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 44422 - protein, 486 aa, Homo sapiens
HVTVAAADSWKPPASAQHVGRAPRAGAATCFLGPRPPSHLGGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFA

SEQ ID NO: 44423 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 44424 - protein, 866 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 44425 - protein, 399 aa, Homo sapiens
MLPLEPYLTQTSAVPQMSHFMCHSPTHKPQGLLPWAPFHQASVSLYPISPWPSESVCPPTCPGGASCWFPAGNAWDRVELGFLGFGAGGVSIAVPGFPLSCGQGCCAGGWLGHGARFPAKLRAFPQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPP

SEQ ID NO: 44426 - protein, 4427 aa, Homo sapiens
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKSLLILFAEIDYWERLLFETPHYVVNVAERAEDLRILRENLLLVARDYNRIIAMLSPDEQALFKERIRLLDKKIHPGLKKLHWALKGASAFFITECRIHASKVQMIVNEFKASTLTIGWRAQEMSEKLLVRISGKRVYRDLEFEEDQREHRAAVQQKLMNLHQDVVTIMTNSYEVFKNDGPEIQQQWMLYMIRLDRMMEDALRLNVKWSLLELSKAINGDGKTSPNPLFQVLVILKNDLQGSVAQVEFSPTLQTLAGVVNDIGNHLFSTISVFCHLPDILTKRKLHREPIQTVVEQDEDIKKIQTQISSGMTNNASLLQNYLKTWDMYREIWEINKDSFIHRYQRLNPPVSSFVADIARYTEVANNVQKEETVTNIQFVLLDCSHLKFSLVQHCNEWQNKFATLLREMAAGRLLELHTYLKENAEKISRPPQTLEELGVSLQLVDALKHDLANVETQIPPIHEQFAILEKYEVPVEDSVLEMLDSLNGEWVVFQQTLLDSKQMLKKHKEKFKTGLIHSADDFKKKAHTLLEDFEFKGHFTSNVGYMSALDQITQVRAMLMAMREEENSLRANLGIFKIEQPPSKDLQNLEKELDALQQIWEIARDWEENWNEWKTGRFLILQTETMETTAHGLFRRLTKLAKEYKDRNWEIIETTRSKIEQFKRTMPLISDLRNPALRERHWDQVRDEIQREFDQESESFTLEQIVELGMDQHVEKIGEISASATKELAIEVALQNIAKTWDVTQLDIVPYKDKGHHRLRGTEEVFQALEDNQVALSTMKASRFVKAFEKDVDHWERCLSLILEVIEMILTVQRQWMYLENIFLGEDIRKQLPNESTLFDQVNSNWKAIMDRMNKDNNALRSTHHPGLLDTLIEMNTILEDIQKSLDMYLETKRHIFPRFYFLSNDDLLEILGQSRNPEAVQPHLKKCFDNIKLLRIQKVGGPSSKWEAVGMFSGDGEYIDFLHSVFLEGPVESWLGDVEQTMRVTLRDLLRNCHLALRKFLNKRDKWVKEWAGQVVITASQIQWTADVTKCLLTAKERADKKILKVMKKNQVSILNKYSEAIRGNLTKIMRLKIVALVTIEIHARDVLEKLYKSGLMDVNSFDWLSQLRFYWEKDLDDCVIRQTNTQFQYNYEYLGNSGRLVITPLTDRCYMTLTTALHLHRGGSPKGPAGTGKTETVKDLGKALGIYVIVVNCSEGLDYKSMGRMYSGLAQTGAWGCFDEFNRINIEVLSVVAHQILCILSALAAGLTHFHFDGFEINLVWSCGIFITMNPGYAGRTELPENLKSMFRPIAMVVPDSTLIAEIILFGEGFGNCKILAKKVYTLYSLAVQQLSRQDHYDFGLRALTSLLRYAGKKRRLQPDLTDEEVLLLSMRDMNIAKLTSVDAPLFNAIVQDLFPNIELPVIDYGKLRETVEQEIRDMGLQSTPFTLTKVFQLYETKNSRHSTMIVGCTGSGKTASWRILQASLSSLCRAGDPNFNIVREFPLNPKALSLGELYGEYDLSTNEWTDGILSSVMRTACADEKPDEKWILFDGPVDTLWIENMNSVMDDNKVLTLINGERIAMPEQVSLLFEVEDLAMASPATVSRCGMVYTDYADLGWKPYVQSWLEKRPKAEVEPLQRMFEKLINKMLAFKKDNCKELVPLPEYSGITSLCKLYSALATPENGVNPADGENYVTMVEMTFVFSMIWSVCASVDEEGRKRIDSYLREIEGSFPNKDTVYEYFVDPKIRSWTSFEDKLPKSWRYPPNAPFYKIMVPTVDTVRYNYLVSSLVANQNPILLVGPVGTGKTSIAQSVLQSLPSSQWSVLVVNMSAQTTSNNVQSIIESRVEKRTKGVYVPFGGKSMITFMDDLNMPAKDMFGSQPPLELIRLWIDYGFWYDRTKQTIKYIREMFLMAAMGPPGGGRTVISPRLRSRFNIINMTFPTKSQIIRIFGTMINQKLQDFEEEVKPIGNVVTEATLDMYNTVVQRFLPTPTKMHYLFNLRDISKVFQGMLRANKDFHDTKSSITRLWIHECFRVFSDRLVDAADTEAFMGIISDKLGSFFDLTFHHLCPSKRPPIFGDFLKEPKVYEDLTDLTVLKTVMETALNEYNLSPSVVPMQLVLFREAIEHITRIVRVIGQPRGNMLLVGIGGSGRQSLARLASSICDYTTFQIEVTKHYRKQEFRDDIKRLYRQAGVELKTTSFIFVDTQIADESFLEDINNILSSGEVPNLYKPDEFEEIQSHIIDQARVEQVPESSDSLFAYLIERVQNNLHIVLCLSPMGDPFRNWIRQYPALVNCTTINWFSEWPQEALLEVAEKCLIGVDLGTQENIHRKVAQIFVTMHWSVAQYSQKMLLELRRHNYVTPTKYLELLSGYKKLLGEKRQELLAQANKLRTGLFKIDETREKVQVMSLELEDAKKKVAEFQKQCEEYLVIIVQQKREADEQQKAVTANSEKIAVEEIKCQALADNAQKDLEEALPALEEAMRALESLNKKDIGEIKSYGRPPAQVEIVMQAVMILRGNEPTWAEAKRQLGEQNFIKSLINFDKDNISDKVLKKIGAYCAQPDFQPDIIGRVSLAAKSLCMWVRAMELYGRLYRVVEPKRIRMNAALAQLREKQAALAEAQEKLREVAEKLEMLKKQYDEKLAQKEELRKKSEEMELKLERAGMLVSGLAGEKARWEETVQGLEEDLGYLVGDCLLAAAFLSYMGPFLTNYRDEIVNQIWIGKIWELQVPCSPSFAIDNFLCNPTKVRDWNIQGLPSDAFSTENGIIVTRGNRWALMIDPQAQALKWIKNMEGGQGLKIIDLQMSDYLRILEHAIHFGYPVLLQNVQEYLDPTLNPMLNKSVARIGGRLLMRIGDKEVEYNTNFRFYITTKLSNPHYSPETSAKTTIVNFAVKEQGLEAQLLGIVVRKERPELEEQKDSLVINIAAGKRKLKELEDEILRLLNEATGSLLDDVQLVNTLHTSKITATEVTEQLETSETTEINTDLAREAYRPCAQRASILFFVLNDMGCIDPMYQFSLDAYISLFILSIDKSHRSNKLEDRIDYLNDYHTYAVYRYTCRTLFERHKLLFSFHMCAKILETSGKLNMDEYNFFLRGGVVLDREGQMDNPCSSWLADAYWDNITELDKLTNFHGLMNSFEQYPRDWHLWYTNAAPEKAMLPGEWENACNEMQRMLIVRSLRQDRVAFCVTSFIITNLGSRFIEPPVLNMKSVLEDSTPRSPLVFILSPGVDPTSALLQLAEHMGMAQRFHALSLGQGQAPIAARLLREGVTQGHWVFLANCHLSLSWMPNLDKLVEQLQVEDPHPSFRLWLSSIPHPDFPISILQVSIKMTTEPPKGLKANMTRLYQLMSEPQFSRCSKPAKYKKLLFSLCFFHSVLLERKKFLQLGWNIIYGFNDSDFEVSENLLSLYLDEYEETPWDALKYLIAGINYGGHVTDDWDRRLLTTYINDYFCDQSLSTPFHRLSALETYFIPKDGSLASYKEYISLLPGMDPPEAFGQHPNADVASQITEAQTLFDTLLSLQPQITPTRAGGQTREEKVLELAADVKQKIPEMIDYEGTQKLLALDPSPLNVVLLQEIQRYNTLMQTILFSLTDLEKGIQGLIVMSTSLEEIFNCIFDAHVPPLWGKAYPSQKPLAAWTRDLAMRVEQFELWASRARPPVIFWLSGFTFPTGFLTAVLQSSARQNNVSVDSLSWEFIVSTVDDSNLVYPPKDGVWVRGLYLEGAGWDRKNSCLVEAEPMQLVCLMPTIHFRPAESRKKSAKGMYSCPCYYYPNRAGSSDRASFVIGIDLRSGAMTPDHWIKRGTALLMSLDS

SEQ ID NO: 44427 - protein, 593 aa, Homo sapiens
MEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKDNGCLIACGSQLGTTTLLEVSPGLSTLQRNEKNVASSMFERETRREKILEARHREMRLKEKGKAEGRDEEQTDEELAVDLEALVSKAEEEFFDIIFAELKKKEADAIKLTPVPQQPSPEEDQVVEEGEEAAGEEGDEEVEEDLA

SEQ ID NO: 44428 - protein, 891 aa, Homo sapiens
EKDNGLDVFKLSDRDFLRSMENAIRFGKPCLLENVGEELDPALEPVLLKQTYKQQGNTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERHKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFNRHSAEFCPQICHLH

SEQ ID NO: 44429 - protein, 4265 aa, Homo sapiens
MEQPNSKGYSLGRTPQGPECSSAPAVQVGTHRGLEYNPGKILPGSDYGLGNPPALDPKLPHLPLPPAPPTLSDLGQPRKSPLTGTDKKYPLMKQRGFYSDILSPGTLDQLGEVCRGPRMSQNLLRQADLDKFTPRVGSFEVPEDFQERMEQQCIGSTTRLLAQTDFPLQAYEPKMQVPFQVLPGQHPRKIEIERRKQQYLSLDIEQLLFSQGIDSNKLMPRHLDHQHPQTIEQGHDPIFPIYLPLKVFDNEDFDCRTPREWINMGLEPGSLDRKPVPGKALLPTDDFLGHEDPKSQKLKYKWCEVGVLDYDEEKKLYLVHKTDEKGLVRDEMGRPILNAGVTTEGRPPLQVCQYWVPRIQLLFCAEDPCMFAQRVVQANALRKNTEALLLYNLYVDCMPSDGQHVISEQSLSKIKQWALSTPRMRKGPSVLEHLSSLAREVSLDYERSMNKINFDHVVSSKPETFSYVTLPKKEEEQVPERGLVSVPKYHFWEQKEDFTFVSLLTRPEVITALSKVRAECNKVTAMSLFHSSLSKYSHLEEFEQIQSQTFSQVQMFLKDSWISSLKVAMRSSLRDMSKGWYNLYETNWEVYLMSKLRKLMELVKYMLQDTLRFLVQDSLASFSQFISDTCCSVLNCTDDMVWGDDLINSPYRPRKNPLFIMDLVLDSSGVHYSTPLEQFEASLLNLFDKGILATHAVPQLEKLVMEDIFISGDPLLESVGLHEPLVEELRATIASAVSKAMIPLQAYAKEYRKYLELNNNDIASFLKTYQTQGLLAQEVREVVLTHLREKEILDSSLPSSIIIGPFYINTDNVKQSLSKKRKALATSVLDILAKNLHKEVDSICEEFRSISRKIYEKPNSIEELAELREWMKGIPERLVGLEERIVKVMDDYQVMDEFLYNLSSDDFNDKWIASNWPSKILGQIELVQQQHVEDEEKFRKIQIMDQNNFQEKLEGLQLVVAGFSIHVEISRAHEIANEVRRVKKQLKDCQQLAMLYNNRERIFSLPITNYDKLSRMVKEFQPYLDLWTTASDWLRWSESWMNDPLSAIDAEQLEKNVVEAFKTMHKCVKQFKDMPACQEVALDIRARIEEFKPYIPLIQGLRNPGMRIRHWETLSNQININVRPKANLTFARCLEMNLQDHIESISKVAEVAGKEYAIEQALDKMEKEWSTILFNVLPYKATDTYILKSPDEASQLLDDHIVMTQNMSFSPYKKPFEQRINSWENKLKLTQEVLEEWLNCQRSWLYLEPIFSSEDINQQLPVESKRYQTMERIWKKIMKNAYENREVINVCSDLRMLDSLRDCNKILDLVQKGLSEYLETKRSAFPRFYFLSDDELLEILSQTKDPTAVQPHLRKCFENIARLLFQEDLEITHMYSAEGEEVQLCFSIYPSSNVEDWLREVERSMKASVHDIIEKAIRAYPTMPRTQWVLNWPGQVTIAGCQTYWTMEVAEALEAGNLRSQLFPQLCQQLSDLVALVRGKLSRMQRAVLSALIVIEVHAKDVVSKLIQENVVSVNDFQWISQLRYYWTNNDLYIRAVNAEFIYGYEYLGNSGRLVITPLTDRCYLTLTGALHLKFGGAPAGPAGTGKTETTKDLGKALAIQTVVFNCSDQLDFMAMGKFFKGLASAGAWACFDEFNRIDIEVLSVVAQQITTIQKAQQQRVERFMFEGVEIPLVPSCAVFITMNPGYAGRTELPDNLKALFRPVAMMVPDYAMITEISLYSFGFNEASVLAKKITTTFKLSSEQLSSQDHYDFGMRAVKTVISAAGNLKRENPSMNEELICLRAIRDVNVPKFLQEDLKLFSGIVSDLFPTIKEEDTDYGILDEAIREACRNSNLKDVEGFLTKCIQLYETTVVRHGLMLVGPTGSGKSTCYRVLAAAMTSLKGQPSISGGMYEAVNYYVLNPKSITMGQLYGEFDLLTHEWTDGIFSSFIRAGAITSDTNKKWYMFDGPVDAIWIENMNTVLDDNKKLCLSSGEIIKLTEAMTMMFEVQDLAVASPATVSRCGMVYLEPSILGLMPFIECWLRKLPPLLKPYEEHFKALFVSFLEESISFVRSSVKEVIASTNCNLTMSLLKLLDCFFKPFLPREGLKKIPSEKLSRIVELIEPWFIFSLIWSVGATGDSSGRTSFSHWLRLKMENEQLTLLFPEEGLVFDYRLEDAGISGTNDSEDEEEEYKQVAWVKWMDSSAPFTMVPDTNYCNIIVPTMDTVQMSHLLDMLLTNKKPVLCIGPTGTGKTLTISDKLLKNLALDYISHFLTFSARTSANQTQDFIDSKLDKRRKGVFGPPLGRNFIFFIDDLNMPALETYGAQPPIELLRQWMDHGGWYDRKIIGAFKNLVDINFVCAMGPPGGGRNTVTPRLMRHFNYLSFAEMDEVSKKRIFSTILGNWLDGLLGEKSYRERVPGAPHIAHFTEPLVEATIMVYATITSQLLPTPAKSHYTFNLRDLSKVFQGMLMADPAKVEDQVQLLRLWYHENCRVFRDRLVNEEDRSWFDQLLKRCMEQWEVTFNKVCPFQPILYGDFMSPGSDVKSYELITSESKMMQVIEEYIEDYNQINTAKLKLVLFMDAMSHICRISRTLRQALGNALLLGVGGSGRSSLTRLASHMAEYECFQIELSKNYGMSEWRDDVKKVLLKAGLQNLPITFLFSDTQIKNESFLEDINNVLNSGDIPNLYTADEQDQIVSTMRPYIQEQGLQPTKANLMAAYTGRVRSNIHMVLCMSPIGEVFRARLRQFPSLVNCCTIDWFNEWPAEALKSVATVFLNEIPELESSQEEIQGLIQVCVYIHQSVSKKCIEYLAELTRHNYVTPKSYLELLHIFSILIGQKKLELKTAKNRMKSGLDKLLRTSEDVAKMQEDLESMHPLLEEAAKDTMLTMEQIKVDTAIAEETRNSVQTEEIKANEKAKKAQAIADDAQKDLDEALPALDAALASLRNLNKNDVTEVRAMQRPPPGVKLVIEAVCIMKGIKPKKVPGEKPGTKVDDYWEPGKGLLQDPGHFLESLFKFDKDNIGDVVIKAIQPYIDNEEFQPATIAKVSKACTSICQWVRAMHKYHFVAKAVEPKRQALLEAQDDLGVTQRILDEAKQRLREVEDGIATMQAKYRECITKKEELELKCEQCEQRLGRAGKLINGLSDEKVRWQETVENLQYMLNNISGDVLVAAGFVAYLGPFTGQYRTVLYDSWVKQLRSHNVPHTSEPTLIGTLGNPVKIRSWQIAGLPNDTLSVENGVINQFSQRWTHFIDPQSQANKWIKNMEKDNGLDVFKLSDRDFLRSMENAIRFGKPCLLENVGEELDPALEPVLLKQTYKQQGNTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERHKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFLTGTLQNFARKFVISIDTISFDFKVMFEAPSELTQRPQVGCYIHGLFLEGARWDPEAFQLAESQPKELYTEMAVIWLLPTPNRKAQDQDFYLCPIYKTLTRAGTLSTTGHSTNYVIAVEIPTHQPQRHWIKRGVALICALDY

SEQ ID NO: 44430 - protein, 4471 aa, Homo sapiens
MVPEEVEVEIDEIPVLSEEGEEEEETYSQKVESVDKVRAKRVSLRTESLGQPLNREDEEMDKEISEKLPSKRTAKHIMEKMHLHMLCTPLPEEFLDQNVVFFLRNTKEAISEATDMKEAMEIMPETLEYGIINANVLHFLKNIICQVFLPALSFNQHRTSTTVGVTSGEVSNSSEHESDLPPMPGEAVEYHSIQLIRDEFLMNVQKFASNIQRTMQQLEGEIKLEMPIISVEGEVSDLAADPETVDILEQCVINWLNQISTAVEAQLKKTPQGKGPLAEIEFWRERNATLSALHEQTKLPIVRKVLDVIKESDSMLVANLQPVFTELFKFHTEASDNVRFLSTVERYFKNITHGSGFHVVLDTIPAMMSALRMVWIISRHYNKDERMIPLMERIAWEIAERVCRVVNLRTLFKENRASAQSKTLEARNTLRLWKKAYFDTRAKIEASGREDRWEFDRKRLFERTDYMATICQDLSDVLQILEEFYNIFGPELKAVTGDPKRIDDVLCRVDGLVTPMENLTFDPFSIKSSQFWKYVMDEFKIEVLIDIINKIFVQNLENPPLYKNHPPVAGAIYWERSLFFRIKHTILRFQEVQEILDSDRGQEVKQKYLEVGRTMKEYEDRKYEQWMEVTEQVLPALMKKSLLTKSSIATEEPSTLERGAVFAINFSPALREIINETKYLEQLGFTVPELARNVALQEDKFLRYTAGIQRMLDHYHMLIGTLNDAESVLLKDHSQELLRVFRSGYKRLNWNSLGIGDYITGCKQAIGKFESLVHQIHKNADDISSRLTLIEAINLFKYPAAKSEEELPGVKEFFEHIERERASDVDHMVRWYLAIGPLLTKVEGLVVHTNTGKAPKLASYYKYWEKKIYEVLTKLILKNLQSFNSLILGNVPLFHTETILTAPEIILHPNTNEIDKMCFHCVRNCVEITKHFVRWMNGSCIECPPQKGEEEEVVIINFYNDISLNPQIIEQAVMIPQNVHRILINLMKYLQKWKRYRPLWKLDKAIVMEKFAAKKPPCVAYDEKLQFYSKIAYEVMRHPLIKDEHCIRLQLRHLANTVQENAKSWVISLGKLLNESAKEELYNLHEEMEHLAKNLRKIPNTLEDLKFVLATIAEIRSKSLVMELRYRDVQERYRTMAMYNLFPPDAEKELVDKIESIWSNLFNDSVNVEHALGDIKRTFTELTRGEIMNYRVQIEEFAKRFYSEGPGSVGDDLDKGVELLGVYERELARHEKSRQELANAEKLFDLPITMYPELLKVQKEMSGLRMIYELYEGLKVAKEEWSQTLWINLNVQILQEGIEGFLRALRKLPRPVRGLSVTYYLEAKMKAFKDSIPLLLDLKNEALRDRHWKELMEKTSVFFEMTETFTLENMFAMELHKHTDVLNEIVTAAIKEVAIEKAVKEILDTWENMKFTVVKYCKGTQERGYILGSVDEIIQSLDDNTFNLQSISGSRFVGPFLQTVHKWEKTLSLIGEVIEIWMLVQRKWMYLESIFIGGDIRSQLPEEAKKFDNIDKVFKRIMGETLKDPVIKRCCEAPNRLSDLQNVSEGLEKCQKSLNDYLDSKRNAFPRFFFISDDELLSILGSSDPLCVQEHMIKMYDNIASLRFNDGDSGEKLVSAMISAEGEVMEFRKILRAEGRVEDWMTAVLNEMRRTNRLITKEAIFRYCEDRSRVDWMLLYQGMVVLAASQVWWTWEVEDVFHKAQKGEKQAMKNYGRKMHRQIDELVTRITMPLSKNDRKKYNTVLIIDVHARDIVDSFIRGSILEAREFDWESQLRFYWDREPDELNIRQCTGTFGYGYEYMGLNGRLVITPLTDRIYLTLTQALSMYLGGAPAGPAGTGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKTLAKKMTVLYKLAREQLSKQYHYDFGLRALKSVLVMAGELKRGSSDLREDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTKLGLTTKLYILNPKAVSVIELYGILDPTTRDWTDGVLSNIFREINKPTDKKERKYILFDGDVDALWVENMNSVMDDNRLLTLANGERIRLQAHCALLFEVGDLQYASPATVSRCGMVYVDPKNLKYRPYWKKWVNQIPNKVEQYNLNSLFEKYVPYLMDVIVEGIVDGRQAEKLKTIVPQTDLNMVTQLAKMLDALLEGEIEDLDLLECYFLEALYCSLGASLLEDGRMKFDEYIKRLASLSTVDTEGVWANPGELPGQLPTLYDFHFDNKRNQWVPWSKLVPEYIHAPERKFINILVHTVDTTRTTWILEQMVKIKQPVIFVGESGTSKTATTQNFLKNLSEETNIVLMVNFSSRTTSMDIQRNLEANVEKRTKDTYGPPMGKRLLVFMDDMNMPRVDEYGTQQPIALLKLLLEKGYLYDRGKELNCKSIRDLGFIAAMGKAGGGRNEVDPRFISLFSVFNVPFPSEESLHLIYSSILKGHTSTFHESIVAVSGKLTFCTLALYKNIVQDLPPTPSKFHYIFNLRDLSRVFNGLVLTNPERFQTVAQMVRVWRNECLRVFHDRLISETDKQLVQQHIGSLVVEHFKDDVEVVMRDPILFGDFQMALHEGEPRIYEDIQDYEAAKALFQEILEEYNESNTKMNLVLFDDALEHLTRVHRIIRMDRGHALLVGVGGSGKQSLSRLAAFTASCEVFEILLSRGYSENSFREDLKSLYLKLGIENKAMIFLFTDAHVAEEGFLELINNMLTSGIVPALFSEEEKESILSQIGQEALKQGMGPAKESVWQYFVNKSANNLHIVLGMSPVGDTLRTWCRNFPGMVNNTGIDWFMPWPPQALHAVAKSFLGYNPMIPAENIENVVKHVVLVHQSVDHYSQQFLQKLRRSNYVTPKNYLDFINTYSKLLDEKTQCNIAQCKRLDGGLDKLKEATIQLDELNQKLAEQKIVLAEKSAACEALLEEIAVNTAVAEEKKKLAEEKAMEIEEQNKVIAMEKAEAETTLAEVMPILEAAKLELQKLDKSDVTEIRSFAKPPKQVQTVCECILIMKGYKELNWKTAKGVMSDPNFLRSLMEIDFDSITQSQVKNIKGLLKTLNTTTEEMEAVSKAGLGMLKFVEAVMGYCDVFREIKPKREKVARLERNFYLTKRELERIQNELAAIQKELETLGAKYEAAILEKQKLQEEAEIMERRLIAADKLISGLGSENIRWLNDLDELMHRRVKLLGDCLLCAAFLSYEGAFTWEFRDEMVNRIWQNDILEREIPLSQPFRLESLLTDDVEISRWGSQGLPPDELSVQNGILTTRASRFPLCIDPQQQALNWIKRKEEKNNLRVASFNDPDFLKQLEMSIKYGTPFLFRDVDEYIDPVIDNVLEKNIKVSQGRQFIILGDKEVDYDSNFRLYLNTKLANPRYSPSVFGKAMVINYTVTLKGLEDQLLSVLVAYERRELEEQREHLIQETSENKNLLKDLEDSLLRELATSTGNMLDNVDLVHTLEETKSKATEVSEKLKLAEKTALDIDRLRDGYRPAARRGAILFFVLSEMALVNSMYQYSLIAFLEVFRLSLKKSLPDSILMKRLRNIMDTLTFSIYNHGCTGLFERHKLLFSFNMTIKIEQAEGRVPQEELDFFLKGNISLEKSKRKKPCAWLSDQGWEDIILLSEMFSDNFGQLPDDVENNQTVWQEWYDLDSLEQFPVPLGYDNNITPFQKLLILRCFRVDRVYRAVTDYVTVTMGEKYVQPPMISFEAIFEQSTPHSPIVFILSPGSDPATDLMKLAERSGFGGNRLKFLAMGQGQEKVALQLLETAVARGQWLMLQNCHLLVKWLKDLEKSLERITKPHPDFRLWLTTDPTKGFPIGILQKSLKVVTEPPNGLKLNMRATYFKISHEMLDQCPHPAFKPLVYVLAFFHAVVQERRKFGKIGWNVYYDFNESDFQVCMEILNTYLTKAFQQRDPRIPWGSLKYLIGEVMYGGRAIDSFDRRILTIYMDEYLGDFIFDTFQPFHFFRNKEVDYKIPVGDEKEKFVEAIEALPLANTPEVFGLHPNAEIGYYTQAARDMWAHLLELQPQTGESSSGISRDDYIGQVAKEIENKMPKVFDLDQVRKRLGTGLSPTSVVLLQELERFNKLVVRMTKSLAELQRALAGEVGMSNELDDVARSLFIGHIPNIWRRLAPDTLKSLGNWMVYFLRRFSQYMLWVTESEPSVMWLSGLHIPESYLTALVQATCRKNGWPLDRSTLFTQVTKFQDADEVNERAGQGCFVSGLYLEGADWDIEKGCLIKSKPKVLVVDLPILKIIPIEAHRLKLQNTFRTPVYTTSMRRNAMGVGLVFEADLFTTRHISHWVLQGVCLTLNSD

SEQ ID NO: 44431 - protein, 4523 aa, Homo sapiens
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKQVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPVAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFMNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLHGLFMEGARWDTQAGTIVEARLKELACPMPVIFAKATPVDRQETKQTYECPVYRTKLRGPSYIWTFRLKSEEKTAKWVLAGVALLLEA

SEQ ID NO: 44432 - protein, 457 aa, Homo sapiens
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEELDCWVVWEVYF

SEQ ID NO: 44433 - protein, 679 aa, Homo sapiens
MFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 44434 - protein, 3092 aa, Homo sapiens
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCRMRARHWKQISEIVGYDLTPDSGTTLRKVLKLNLTPYLEQFEVISAGASKEFSLEKAMNTMIGTWEDIAFHISLYRDTGVCILSSVDEIQAILDDQIIKTQTMRGSPFIKPFEHEIKAWEDRLIRIQETIDEWLKVQAQWLYLEPIFCSEDIMQQMPEEGRQFQTVDRHWRDIMKFCAKDPKVLAATSLTGLLEKLQNCNELLEKIMKGLNAYLEKKRLFFPRFFFLSNDEMLEILSETKDPLRVQPHLKKCFEGIAKLEFLPNLDIKAMYSSEGERVELIALISTSAARGAVEKWLIQVEDLMLRSVHDVIAAARLAYPESARRDWVREWPGQVVLCISQMFWTSETQEVISGGTEGLKKYYKELQNQLNEIVELVRGKLSKQTRTTLGALVTIDVHARDVVMDMIKMGVSHDTDFLWLAQLRYYWENENARVRIINCNVKYAYEYLGNSPRLVITPLTDRCYRTLIGAFYLNLGGAPEGPAGTGKTETTKDLAKALAVQCVVFNCSDGLDYLAMGKFFKGLASSGAWACFDEFNRIELEVLSVVAQQILCIQRAIQQKLVVFVFEGTELKLNPNCFVAITMNPGYAGRSELPDNLKVLFRTVAMMVPNYALIAEISLYSYGFLNARPLSVKIVMTYRLCSEQLSSQFHYDYGMRAVKAVLVAAGNLKLKYPNENEDILLLRSIKDVNEPKFLSHDIPLFNGITSDLFPGIKLPEADYHEFLECAHEACNVHNLQPVKFFLEKIIQTYEMMIVRHGFMLVGEPFAAKTKVLHVLADTLTLMNEHGYGEEEKVIYRTVNPKSITMGQLFGQFDPVSHEWTDGIVANTFREFALSETPDRKWVVFDGPIDTLWIESMNTVLDDNKKLCLMSGEIIQMSPQMSLIFETMDLSQASPATVSRCGMIYLEPSQLGWEPLVSSWLNSLKGPLCEPEYQALLRGLFAWLIPPSLNQRVELFQLNYLYTTIVSKILKILITFRISNYFKYVPLKTQCTFIKFFLHQQACFIFSLIWSIGGSCDTDGRRVFDTFIRLIILGKDDENPVPDSVGKWECPFDEKGLVYDYMYELKNKGRWVHWNELIKNTNLGDKQIKIQDIIVPTMDTIRYTFLMDLSITYAKPLLFVGPTGTGKSVYVKDKLMNHLEKDQYFPFYINLSARTSANQVQNIIMARLDKRRKGVFGPPMGKKCIIFIDDMNMPALEKYGAQPPIELLRQFFDCGHWYDLKDTSKITLVDIELIAAMGPPGGGRNPVTPRCIRHFNICSINSFSDETMVRIFSSIVAFYLRTHEFPPEYFVIGNQIVNGTMEIYKQSVENLLPTPTKSHYTFNLRDFSRVIRGCLLIERDAVANKHTMIRLFVHEVLRVFYDRLINDDDRRWLFQLTKTVIKDHFKESFHSIFSHLRKQNAPVTEEDLRNLMFGDYMNPDLEGDDRVYIEIPNIHHFSDVVDQCLDEYNQTHKTRMNLVIFRYVLEHLSRICRVLKQSGGNALLVGLGGSGRQSLTRLATSMAKMHIFQPEISKSYGMNEWREDMKSFIAVPVTNRIVDNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 44435 - protein, 784 aa, Homo sapiens
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCSTVMEQIKAFKV

SEQ ID NO: 44436 - protein, 228 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 44437 - protein, 228 aa, Homo sapiens; identical to SEQ ID NO: 44436

SEQ ID NO: 44438 - protein, 453 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 44439 - protein, 4515 aa, Homo sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISDTEIETEFENKYMYYEFPEFPTNLFIDPNRLEFSVKIQNMLTNMEKCITTITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVSLDYQSECLLYIDNVIHMSHTLIQSVIEKKNKNLLEVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKGLPKSDMVTHLKQVVTEFKQELPIIIALGNPCLKPRHWEALQEIIGKSVPLDKNCKVENLLALKMFQYENEINDMSTSATNEAALEKMLFKIIDFWNTTPLPLILHHTEIYSIFIIPSIDDISAQLEESQVILATIKGSPHIGPIKDLVNEWDQNLTLFSYTLEEWMNCQRNWLYLEPVFHSSEIRRQLPAETELFSQVISMWKKIMSKIQNKQNALQITTSAGVLEILQNCNIHLEHIKKSLEDYLEVKRLIFPRFYFLSNAELLDILADSRNPESVQPHLVKCFENIKQLLIWKQDIGPPAVKMLISAEGEGLVLPKKIRVRSAVEQWLVNVEKSMFDVLKKERYIYNIILLFQSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKSLGKHCVVFNCFEDLDYKIVRKFFFGLVQSGAWSCFDEFNLIDLEVLSVIASQILTIKAAKDNYSARFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGWKHWGQSQGRRRKGNCINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQAHLGIYFSINNFTPEVQKSKDQIISCSLAIYHQVRQNMLPTPTKCHYMFNLRDMFKLLLGLLQADRTVVNSKEMAALLFVHEATRVFHDRLIDFTDKSLFYRLLSRELENCFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKTRWQETINQIDNKLEGILGDILLSAACIVYSGILTPEFRQLIVNKWETFCIENGISLSSKFSLIKVMAQKYEISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEETELLNENKETCNPINFPWEKLTSFQRLILVKVLRPESLNNSVRKFITEKMGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSRSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 44440 - protein, 4515 aa, Homo sapiens; identical to SEQ ID NO: 44439

SEQ ID NO: 44441 - protein, 3507 aa, Homo sapiens
MGRRSQWIWAMRCQMLVPVLSLHIGLARALGCGCIASKIECLIRCNAPFPLLDAVGSVASQELQSLTGTVGVTSGAAAYPRWNLARARAPPHLPGTQDPLRRVRDPTPIVASSPGRRRGSWSGGYGQEASEPGVVGLCCAVLPIHPSLALAGVGGPDLRRFQEGPQRPSDHGAAEKHMETFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISATITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKEIYSIFIIPSIDDISAQLEESQVILATIKGSPHIGPIKSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKCALFAFKCNTALIKLPNSLIVLTCFGLEKTVLVMNTVMSFRFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCDTSDSLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGINLPTGECSIFGYFVDIEQCEFIPWSDLVPNDQTLIQRDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLISRWHNQGLPHGQYSVENAILIKNGQQWPLLIDPHRQAHKWIRQMEGSRLQKLSIEDSNYTKKIENAMKTGGSVLLQSCQASTWRKKLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEEKHTFCLLLRAINHTGTDLGPVGRGQWLTSTACDRHTDVCSFSFALNDGVPDVEHVQDIFYGHCVDKYHVKVLRPESLNNSVRKFITEKMGNKYLQRTGVNLKDAYKGSNARTPLILIQTHGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 44442 - protein, 872 aa, Homo sapiens
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKMSNEIIRLCCHAISLDRIFEGYVSSSKEDLQGCILCCHAWKDHYVQAVQMHIQFSSRGWVLDQTSIFAQVDAFVQRCKDLIEVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKYRSHLAPFPYTPLLQLSQEFHSHLLTPLFIILSLSHTICLLSSFYFFFSSFIFVSPHLPPCYQHFNFTTYLKTQQNKTMIGQARWLTPVIPALWEAEVGASLEPRSLRTAWATWQNPVSAKNTKISWAWWHKPVVSATWEGEVGGSPEPGRQRLQ

SEQ ID NO: 44443 - protein, 4196 aa, Homo sapiens
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKSLLILFAEIDYWERLLFETPHYVVNVAERAEDLRILRENLLLVARDYNRIIAMLSPDEQALFKERIRLLDKKIHPGLKKLHWALKGASAFFITECRIHASKVQMIVNEFKASTLTIGWRAQEMSEKLLVRISGKRVYRDLEFEEDQREHRAAVQQKLMNLHQDVVTIMTNSYEVFKNDGPEIQQQWMLYMIRLDRMMEDALRLNVKWSLLELSKAINGDGKTSPNPLFQVLVILKNDLQGSVAQVEFSPTLQTLAGVVNDIGNHLFSTISVFCHLPDILTKRKLHREPIQTVVEQDEDIKKIQTQISSGMTNNASLLQNYLKTWDMYREIWEINKDSFIHRYQRLNPPVSSFVADIARYTEVANNVQKEETVTNIQFVLLDCSHLKFSLVQHCNEWQNKFATLLREMAAGRLLELHTYLKENAEKISRPPQTLEELGVSLQLVDALKHDLANVETQIPPIHEQFAILEKYEVPVEDSVLEMLDSLNGEWVVFQQTLLDSKQMLKKHKEKFKTGLIHSADDFKKKAHTLLEDFEFKGHFTSNVGYMSALDQITQVRAMLMAMREEENSLRANLGIFKIEQPPSKDLQNLEKELDALQQIWEIARDWEENWNEWKTGRFLILQTETMETTAHGLFRRLTKLAKEYKDRNWEIIETTRSKIEQFKRTMPLISDLRNPALRERHWDQVRDEIQREFDQESESFTLEQIVELGMDQHVEKIGEISASATKELAIEVALQNIAKTWDVTQLDIVPYKDKGHHRLRGTEEVFQALEDNQVALSTMKASRFVKAFEKDVDHWERCLSLILEVIEMILTVQRQWMYLENIFLGEDIRKQLPNESTLFDQVNSNWKAIMDRMNKDNNALRSTHHPGLLDTLIEMNTILEDIQKSLDMYLETKRHIFPRFYFLSNDDLLEILGQSRNPEAVQPHLKKCFDNIKLLRIQKVGGPSSKWEAVGMFSGDGEYIDFLHSVFLEGPVESWLGDVEQTMRVTLRDLLRNCHLALRKFLNKRDKWVKEWAGQVVITASQIQWTADVTKCLLTAKERADKKILKVMKKNQVSILNKYSEAIRGNLTKIMRLKIVALVTIEIHARDVLEKLYKSGLMDVNSFDWLSQLRFYWEKDLDDCVIRQTNTQFQYNYEYLGNSGRLVITPLTDRCYMTLTTALHLHRGGSPKGPAGTGKTETVKDLGKALGIYVIVVNCSEGLDYKSMGRMYSGLAQTGAWGCFDEFNRINIEVLSVVAHQILCILSALAAGLTHFHFDGFEINLVWSCGIFITMNPGYAGRTELPENLKSMFRPIAMVVPDSTLIAEIILFGEGFGNCKILAKKVYTLYSLAVQQLSRQDHYDFGLRALTSLLRYAGKKRRLQPDLTDEEVLLLSMRDMNIAKLTSVDAPLFNAIVQDLFPNIELPVIDYGKLRETVEQEIRDMGLQSTPFTLTKVFQLYETKNSRHSTMIVGCTGSGKTASWRILQASLSSLCRAGDPNFNIVREFPLNPKALSLGELYGEYDLSTNEWTDGILSSVMRTACADEKPDEKWILFDGPVDTLWIENMNSVMDDNKVLTLINGERIAMPEQVSLLFEVEDLAMASPATVSRCGMVYTDYADLGWKPYVQSWLEKRPKAEVEPLQRMFEKLINKMLAFKKDNCKELVPLPEYSGITSLCKLYSALATPENGVNPADGENYVTMVEMTFVFSMIWSVCASVDEEGRKRIDSYLREIEGSFPNKDTVYEYFVDPKIRSWTSFEDKLPKSWRYPPNAPFYKIMVPTVDTVRYNYLVSSLVANQNPILLVGPVGTGKTSIAQSVLQSLPSSQWSVLVVNMSAQTTSNNVQSIIESRVEKRTKGVYVPFGGKSMITFMDDLNMPAKDMFGSQPPLELIRLWIDYGFWYDRTKQTIKYIREMFLMAAMGPPGGGRTVISPRLRSRFNIINMTFPTKSQIIRIFGTMINQKLQDFEEEVKPIGNVVTEATLDMYNTVVQRFLPTPTKMHYLFNLRDISKVFQGMLRANKDFHDTKSSITRLWIHECFRVFSDRLVDAADTEAFMGIISDKLGSFFDLTFHHLCPSKRPPIFGDFLKEPKVYEDLTDLTVLKTVMETALNEYNLSPSVVPMQLVLFREAIEHITRIVRVIGQPRGNMLLVGIGGSGRQSLARLASSICDYTTFQIEVTKHYRKQEFRDDIKRLYRQAGVELKTTSFIFVDTQIADESFLEDINNILSSGEVPNLYKPDEFEEIQSHIIDQARVEQVPESSDSLFAYLIERVQNNLHIVLCLSPMGDPFRNWIRQYPALVNCTTINWFSEWPQEALLEVAEKCLIGVDLGTQENIHRKVAQIFVTMHWSVAQYSQKMLLELRRHNYVTPTKYLELLSGYKKLLGEKRQELLAQANKLRTGLFKIDETREKVQVMSLELEDAKKKVAEFQKQCEEYLVIIVQQKREADEQQKALESLNKKDIGEIKSYGRPPAQVEIVMQAVMILRGNEPTWAEAKRQLGEQNFIKSLINFDKDNISDKVLKKIGAYCAQPDFQPDIIGRVSLAAKSLCMWVRAMELYGRLYRVVEPKRIRMNAALAQLREKQAALAEAQEKLREVAEKLEMLKKQYDEKLAQKEELRKKSEEMELKLERAGMLVSGLAGEKARWEETVQGLEEDLGYLVGDCLLAAAFLSYMGPFLTNYRDEIVNQIWIGKIWELQVPCSPSFAIDNFLCNPTKVRDWNIQGLPSDAFSTENGIIVTRGNRWALMIDPQAQALKWIKNMEGGQGLKIIDLQMSDYLRILEHAIHFGYPVLLQNVQEYLDPTLNPMLNKSVARIGGRLLMRIGDKEVEYNTNFRFYITTKLSNPHYSPETSAKTTIVNFAVKEQGLEAQLLGIVVRKERPELEEQKDSLVINIAAGKRKLKELEDEILRLLNEATGSLLDDVQLVNTLHTSKITATEVTEQLETSETTEINTDLAREAYRPCAQRASILFFVLNDMGCIDPMYQFSLDAYISLFILSIDKSHRSNKLEDRIDYLNDYHTYAVYRYTCRTLFERHKLLFSFHMCAKILETSGKLNMDEYNFFLRGGVVLDREGQMDNPCSSWLADAYWDNITELDKLTNFHGLMNSFEQYPRDWHLWYTNAAPEKAMLPGEWENACNEMQRMLIVRSLRQDRVAFCVTSFIITNLGSRFIEPPVLNMKSVLEDSTPRSPLVFILSPGVDPTSALLQLAEHMGMAQRFHALSLGQGQAPIAARLLREGVTQGHWVFLANCHLSLSWMPNLDKLVEQLQVEDPHPSFRLWLSSIPHPDFPISILQVSIKMTTEPPKGLKANMTRLYQLMSEPQFSRCSKPAKYKKLLFSLCFFHSVLLERKKFLQLGWNIIYGFNDSDFEVSENLLSLYLDEYEETPWDALKYLIAGINYGGHVTDDWDRRLLTTYINDYFCDQSLSTPFHRLSALETYFIPKDGSLASYKEYISLLPGMDPPEAFGQHPNADVASQITEAQTLFDTLLSLQPQITPTRAGGQTREEKVLELAADVKQKIPEMIDYEGTQKLLALDPSPLNVVLLQEIQRYNTLMQTILFSLTDLEIPSCVSHKSERVVLELSAVKHPRQ

SEQ ID NO: 44444 - protein, 4427 aa, Homo sapiens; identical to SEQ ID NO: 44426

SEQ ID NO: 44445 - protein, 4116 aa, Homo sapiens
MGATGRLELTLAAPPHPGPAFQRSKARETQGEEEGSEMQIAKSDSIHHMSHSQGQPELPPLPASANEEPSGLYQTVMSHSFYPPLMQRTSWTLAAPFKEQHHHRGPSDSIANNYSLMAQDLKLKDLLKVYQPATISVPRDRTGQGLPSSGNRSSSEPMRKKTKFSSRNKEDSTRIKLAFKTSIFSPMKKEVKTSLTFPGSRPMSPEQQLDVMLQQEMEMESKEKKPSESDLERYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAEFRDLRFVRTAEILAGKLPLQPQEFWDVIQKHCLEAHQTLLNKWIPTCAQLFTSRKEHWIHFAPKSNYDSSRNIEEYFASVASFMSLQLRELVIKSLEDLVSLFMIHKDGNDFKEPYQEMKFFIPQLIMIKLEVSEPIIVFNPSFDGCWELIRDSFLEIIKNSNGIPKLKYIPLKFSFTAAAADRQCVKAAEPGEPSMHAAATAMAELKGYNLLLGTVNAEEKLVSDFLIQTFKVFQKNQVGPCKYLNVYKKYVDLLDNTAEQNIAAFLKENHDIDDFVTKINAIKKRRNEIASMNITVPLAMFCLDATALNHDLCERAQNLKDHLIQFQVDVNRDTNTSICNQYSHIADKVSEVPANTKELVSLIEFLKKSSAVTVFKLRRQLRDASERLEFLMDYADLPYQIEDIFDNSRNLLLHKRDQAEMDLIKRCSEFELRLEGYHRELESFRKREVMTTEEMKHNVEKLNELSKNLNRAFAEFELINKEEELLEKEKSTYPLLQAMLKNKVPYEQLWSTAYEFSIKSEEWMNGPLFLLNAEQIAEEIGNMWRTTYKLIKTLSDVPAPRRLAENVKIKIDKFKQYIPILSISCNPGMKDRHWQQISEIVGYEIKPTETTCLSNMLEFGFGKFVEKLEPIGAAASKEYSLEKNLDRMKLDWVNVTFSFVKYRDTDTNILCAIDDIQMLLDDHVIKTQTMCGSPFIKPIEAECRKWEEKLIRIQDNLDAWLKCQATWLYLEPIFSSEDIIAQMPEEGRKFGIVDSYWKSLMSQAVKDNRILVAADQPRMAEKLQEANFLLEDIQKGLNDYLEKKRLFFPRFFFLSNDELLEILSETKDPLRVQPHLKKCFEGIAKLEFTDNLEIVGMISSEKETVPFIQKIYPANAKGMVEKWLQQVEQMMLASMREVIGLGIEAYVKVPRNHWVLQWPGQVVICVSSIFWTQEVSQALAENTLLDFLKKSNDQIAQIVQLVRGKLSSGARLTLGALTVIDVHARDVVAKLSEDRVSDLNDFQWISQLRYYWVAKDVQVQIITTEALYGYEYLGNSPRLVITPLTDRCYRTLMGALKLNLGGAPEGPAGTGKTETTKDLAKALAKQCVVFNCSDGLDYKAMGKFFKGLAQAGAWACFDEFNRIEVEVLSVVAQQILSIQQAIIRKLKTFIFEGTELSLNPTCAVFITMNPGYAGRAELPDNLKALFRTVAMMVPDYALIGEISLYSMGFLDSRSLAQKIVATYRLCSEQLSSQHHYDYGMRAVKSVLTAAGNLKLKYPEENESVLLLRALLDVNLAKFLAQDVPLFQGIISDLFPGVVLPKPDYEVFLKVLNDNIKKMKLQPVPWFIGKIIQIYEMMLVRHGYMIVGDPMGGKTSAYKVLAAALGDLHAANQMEEFAVEYKIINPKAITMGQLYGCFDQVSHEWMDGVLANAFREQASSLSDDRKWIIFDGPVDAIWIENMNTVLDDNKKLCLMSGEIIQMNSKMSLIFEPADLEQASPATVSRCGMIYMEPHQLGWKPLKDSYMDTLPSSLTKEHKELVNDMFMWLVQPCLEFGRLHCKFVVQTSPIHLAFSMMRLYSSLLDEIRAVEEEEMELGEGLSSQQIFLWLQGLFLFSLVWTVAGTINADSRKKFDVFFRNLIMGMDDNHPRPKSVKLTKNNIFPERGSIYDFYFIKQASGHWETWTQYITKEEEKVPAGAKVSELIIPTMETARQSFFLKTYLDHEIPMLFVGPTGTGKSAITNNFLLHLPKNTYLPNCINFSARTSANQTQDIIMSKLDRRRKGLFGPPIGKKAVVFVDDLNMPAKEVYGAQPPIELLRQWIDHGYWFDKKDTTRLDIVDMLLVTAMGPPGGGRNDITGRFTRHLNIISINAFEDDILTKIFSSIVDWHFGKGFDVMFLRYGKMLVQATKTIYRDAVENFLPTPSKSHYVFNLRDFSRVIQGVLLCPHTHLQDVEKCIRLWIHEVYRVFYDRLIDKEDRQVFFNMVKETTSNCFKQTIEKVLIHLSPTGKIVDDNIRSLFFGDYFKPESDQKIYDEITDLKQLTVVMEHYLEEFNNISKAPMSLVMFRFAIEHISRICRVLKQDKGHLLLVGIGGSGRQSAAKLSTFMNAYELYQIEITKNYAGNDWREDLKKIILQVGVATKSTVFLFADNQIKDESFVEDINMLLNTGDVPNIFPADEKADIVEKMQTAARTQGEKVEVTPLSMYNFFIERVINKISFSLAMSPIGDAFRNRLRMFPSLINCCTIDWFQSWPTDALELVANKFLEDVELDDNIRVEVVSMCKYFQESVKKLSLDYYNKLRRHNYVTPTSYLELILTFKTLLNSKRQEVAMMRNRYLTGLQKLDFAASQVAVMQRELTALQPQLILTSEETAKMMVKIEAETREADGKKLLVQADEKEANVAAAIAQGIKNECEGDLAEAMPALEAALAALDTLNPADISLVKSMQNPPGPVKLVMESICIMKGMKPERKPDPSGSGKMIEDYWGVSKKILGDLKFLESLKTYDKDNIPPLTMKRIRERFINHPEFQPAVIKNVSSACEGLCKWVRAMEVYDRVAKVVAPKRERLREAEGKLAAQMQKLNQKRAELKLVVDRLQALNDDFEEMNTKKKDLEENIEICSQKLVRAEKLISGLGGEKDRWTEAARQLGIRYTNLTGDVLLSSGTVAYLGAFTVDYRVQCQNQWLAECKDKVIPGFSDFSLSHTLGDPIKIRAWQIAGLPVDSFSIDNGIIVSNSRRWALMIDPHGQANKWIKNMEKANKLAVIKFSDSNYMRMLENALQLGTPVLIENIGEELDASIEPILLKATFKQQGVEYMRLGENIIEYSRDFKLYITTRLRNPHYLPEVAVKVCLLNFMITPLGLQDQLLGIVAAKEKPELEEKKNQLIVESAKNKKHLKEIEDKILEVLSMSKGNILEDETAIKVLSSSKVLSEEISEKQKVASMTETQIDETRMGYKPVAVHSATIFFCISDLANIEPMYQYSLTWFINLYMHSLTHSTKSEELNLRIKYIIDHFTLSIYNNVCRSLFEKDKLLFSLLLTIGIMKQKKEITEEVWYFLLTGGIALDNPYPNPAPQWLSEKAWAEIVRASALPKLHGLMEHLEQNLGEWKLIYDSAWPHEEQLPGSWKFSQGLEKMVILRCLRPDKMVPAVREFIAEHMGKLYIEAPTFDLQGSYNDSSCCAPLIFVLSPSADPMAGLLKFADDLGMGGTRTQTISLGQGQGPIAAKMINNAIKDGTWVVLQNCHLAASWMPTLEKICEEVIVPESTNARFRLWLTSYPSEKFPVSILQNGIKMTNEPPKGLRANLLRSYLNDPISDPVFFQSCAKAVMWQKMLFGLCFFHAVVQERRNFGPLGWNIPYEFNESDLRISMWQIQMFLNDYKEVPFDALTYLTGECNYGGRVTDDKDRRLLLSLLSMFYCKEIEEDYYSLAPGDTYYIPPHGSYQSYIDYLRNLPITAHPEVFGLHENADITKDNQETNQLFEGVLLTLPRQSGGSGKSPQEVVEELAQDILSKLPRDFDLEEVMKLYPVVYEESMNTVLRQELIRFNRLTKVVRRSLINLGRAIKGQVLMSSELEEVFNSMLVGKVPAMWAAKSYPSLKPLGGYVADLLARLTFFQEWIDKGPPVVFWISGFYFTQSFLTGVSQNYARKYTIPIDHIGFEFEVTPQETVMENNPEDGAYIKGLFLEGARWDRKTMQIGESLPKILYDPLPIIWLKPGESAMFLHQDIYVCPVYKTSARRGTLSTTGHSTNYVLSIELPTDMPQKHWINRGVASLCQLDN

SEQ ID NO: 44446 - protein, 753 aa, Homo sapiens
MGDMDCSSQKIAKSDSIHHMSHSQGQPELPPLPASANEEPSGLYQTVMSHSFYPPLMQRTSWTLAAPFKEQHHHRGPSDSIANNYSLMAQDLKLKDLLKVYQPATISVPRDRTGQGLPSSGNRSSSEPMRKKTKFSSRNKEDSTRIKLAFKTSIFSPMKKEVKTSLTFPGSRPMSPEQQLDVMLQQEMEMESKEKKPSESDLERYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAEFRDLRFVRTAEILAGKLPLQPQEFWDVIQKHCLEAHQTLLNKWIPTCAQLFTSRKEHWIHFAPKSNYDSSRNIEEYFASVASFMSLQLRELVIKSLEDLVSLFMIHKDGNDFKEPYQEMKFFIPQLIMIKLEVSEPIIVFNPSFDGCWELIRDSFLEIIKNSNGIPKVESVLFPELKGYNLLLGTVNAEEKLVSDFLIQTFKVFQKNQVGPCKYLNVYKKYVDLLDNTAEQNIAAFLKENHDIDDFVTKINAIKKRRNEIASMNITVPLAMFCLDATALNHDLCERAQNLKDHLIQFQVDVNRDTNTSICNQYSHIADKVSEVPANTKELVSLIEFLKKSSAVTVFKLRRQLRDASERLEFLMDYADLPYEDIKLNSTLFLWPDQIEDIFDNSRNLLLHKRDQAEMDLIKRYRESLGLSWK

SEQ ID NO: 44447 - protein, 1887 aa, Homo sapiens
MGATGRLELTLAAPPHPGPAFQRSKARETQGEEEGSEMQIAKSDSIHHMSHSQGQPELPPLPASANEEPSGLYQTVMSHSFYPPLMQRTSWTLAAPFKEQHHHRGPSDSIANNYSLMAQDLKLKDLLKVYQPATISVPRDRTGQGLPSSGNRSSSEPMRKKTKFSSRNKEDSTRIKLAFKTSIFSPMKKEVKTSLTFPGSRPMSPEQQLDVMLQQEMEMESKEKKPSESDLERYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAEFRDLRFVRTAEILAGKLPLQPQEFWDVIQKHCLEAHQTLLNKWIPTCAQLFTSRKEHWIHFAPKSNYDSSRNIEEYFASVASFMSLQLRELVIKSLEDLVSLFMIHKDGNDFKEPYQEMKFFIPQLIMIKLEVSEPIIVFNPSFDGCWELIRDSFLEIIKNSNGIPKLKYIPLKFSFTAAAADRQCVKAAEPGEPSMHAAATAMAELKGYNLLLGTVNAEEKLVSDFLIQTFKVFQKNQVGPCKYLNVYKKYVDLLDNTAEQNIAAFLKENHDIDDFVTKINAIKKRRNEIASMNITVPLAMFCLDATALNHDLCERAQNLKDHLIQFQVDVNRDTNTSICNQYSHIADKVSEVPANTKELVSLIEFLKKSSAVTVFKLRRQLRDASERLEFLMDYADLPYQIEDIFDNSRNLLLHKRDQAEMDLIKRCSEFELRLEGYHRELESFRKREVMTTEEMKHNVEKLNELSKNLNRAFAEFELINKEEELLEKEKSTYPLLQAMLKNKVPYEQLWSTAYEFSIKSEEWMNGPLFLLNAEQIAEEIGNMWRTTYKLIKTLSDVPAPRRLAENVKIKIDKFKQYIPILSISCNPGMKDRHWQQISEIVGYEIKPTETTCLSNMLEFGFGKFVEKLEPIGAAASKEYSLEKNLDRMKLDWVNVTFSFVKYRDTDTNILCAIDDIQMLLDDHVIKTQTMCGSPFIKPIEAECRKWEEKLIRIQDNLDAWLKCQATWLYLEPIFSSEDIIAQMPEEGRKFGIVDSYWKSLMSQAVKDNRILVAADQPRMAEKLQEANFLLEDIQKGLNDYLEKKRLFFPRFFFLSNDELLEILSETKDPLRVQPHLKKCFEGIAKLEFTDNLEIVGMISSEKETVPFIQKIYPANAKGMVEKWLQQVEQMMLASMREVIGLGIEAYVKVPRNHWVLQWPGQVVICVSSIFWTQEVSQALAENTLLDFLKKSNDQIAQIVQLVRGKLSSGARLTLGALTVIDVHARDVVAKLSEDRVSDLNDFQWISQLRYYWVAKDVQVQIITTEALYGYEYLGNSPRLVITPLTDRCYRTLMGALKLNLGGAPEGPAGTGKTETTKDLAKALAKQCVVFNCSDGLDYKAMGKFFKGLAQAGAWACFDEFNRIEVEVLSVVAQQILSIQQAIIRKLKTFIFEGTELSLNPTCAVFITMNPGYAGRAELPDNLKALFRTVAMMVPDYALIGEISLYSMGFLDSRSLAQKIVATYRLCSEQLSSQHHYDYGMRAVKSVLTAAGNLKLKYPEENESVLLLRALLDVNLAKFLAQDVPLFQGIISDLFPGVVLPKPDYEVFLKVLNDNIKKMKLQPVPWFIGKIIQIYEMMLVRHGYMIVGDPMGGKTSAYKVLAAALGDLHAANQMEEFAVEYKIINPKAITMGQLYGCFDQVSHEWMDGVLANAFREQASSLSDDRKWIIFDGPVDAIWIENMNTVLDDNKKLCLMSGEIIQMNSKMSLIFEPADLEQASPATVSRCGMIYMEPHQLGWKPLKDSYMDTLPSSLTKEHKELMKSGQ

SEQ ID NO: 44448 - protein, 153 aa, Homo sapiens
MLHMGLAHVKRMPRSSRLQCKEAQAFFSLQSGTYRVLSTPLKLGVWEEKKHWAALLQPVSLGRKWKKRPCNLDDYVWGQLKYIPLKFSFTAAAADRQCVKAAEPGEPSMHAAATAMAGTRAGTTFDELQCQEDMVCTRFENKAYVNTNDFTRQ

SEQ ID NO: 44449 - protein, 4624 aa, Homo sapiens
MFRIGRRQLWKHSVTRVLTQRLKGEKEAKRALLDARHNYLFAIVASCLDLNKTEVEDAILEGNQIERIDQLFAVGGLRHLMFYYQDVEEAETGQLGSLGGVNLVSGKIKKPKVFVTEGNDVALTGVCVFFIRTDPSKAITPDNIHQEVSFNMLDAADGGLLNSVRRLLSDIFIPALRATSHGWGELEGLQDAANIRQEFLSSLEGFVNVLSGAQESLKEKVNLRKCDILELKTLKEPTDYLTLANNPETLGKIEDCMKVWIKQTEQVLAENNQLLKEADDVGPRAELEHWKKRLSKFNYLLEQLKSPDVKAVLAVLAAAKSKLLKTWREMDIRITDATNEAKDNVKYLYTLEKCCDPLYSSDPLSMMDAIPTLINAIKMIYSISHYYNTSEKITSLFVKVTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHNELRKFMDVTFAKIQNTNQALRMLKKFERLNIPNLGIDDKYQLILENYGADIDMISKLYTKQKYDPPLARNQPPIAGKILWARQLFHRIQQPMQLFQQHPAVLSTAEAKPIIRSYNRMAKVLLEFEVLFHRAWLRQIEEIHVGLEASLLVKAPGTGELFVNFDPQILILFRETECMAQMGLEVSPLATSLFQKRDRYKRNFSNMKMMLAEYQRVKSKIPAAIEQLIVPHLAKVDEALQPGLAALTWTSLNIEAYLENTFAKIKDLELLLDRVNDLIEFRIDAILEEMSSTPLCQLPQEEPLTCEEFLQMTKDLCVNGAQILHFKSSLVEEAVNELVNMLLDVEVLSEEESEKISNENSVNYKNESSAKREEGNFDTLTSSINARANALLLTTVTRKKKETEMLGEEARELLSHFNHQNMDALLKVTRNTLEAIRKRIHSSHTINFRDSNSASNMKQNSLPIFRASVTLAIPNIVMAPALEDVQQTLNKAVECIISVPKGVRQWSSELLSKKKIQERKMAALQSNEDSDSDVEMGENELQDTLEIASVNLPIPVQTKNYYKNVSENKEIVKLVSVLSTIINSTKKEVITSMDCFKRYNHIWQKGKEEAIKTFITQSPLLSEFESQILYFQNLEQEINAEPEYVCVGSIALYTADLKFALTAETKAWMVVIGRHCNKKYRSEMENIFMLIEEFNKKLNRPIKDLDDIRIAMAALKEIREEQISIDFQVGPIEESYALLNRYGLLIAREEIDKVDTLHYAWEKLLARAGEVQNKLVSLQPSFKKELISAVEVFLQDCHQFYLDYDLNGPMASGLKPQEASDRLIMFQNQFDNIYRKYITYTGGEELFGLPATQYPQLLEIKKQLNLLQKIYTLYNSVIETVNSYYDILWSEVNIEKINNELLEFQNRCRKLPRALKDWQAFLDLKKIIDDFSECCPLLEYMASKAMMERHWERITTLTGHSLDVGNESFKLRNIMEAPLLKYKEEIEDICISAVKERDIEQKLKQVINEWDNKTFTFGSFKTRGELLLRGDSTSEIIANMEDSLMLLGSLLSNRYNMPFKAQIQKWVQYLSNSTDIIESWMTVQNLWIYLEAVFVGGDIAKQLPKEAKRFSNIDKSWVKIMTRAHEVPSVVQCCVGDETLGQLLPHLLDQLEICQKSLTGYLEKKRLCFPRFFFVSDPALLEILGQASDSHTIQAHLLNVFDNIKSVKFHEKIYDRILSISSQEGETIELDKPVMAEGNVEVWLNSLLEESQSSLHLVIRQAAANIQETGFQLTEFLSSFPAQVGLLGIQMIWTRDSEEALRNAKFDKKIMQKTNQAFLELLNTLIDVTTRDLSSTERVKYETLITIHVHQRDIFDDLCHMHIKSPMDFEWLKQCRFYFNEDSDKMMIHITDVAFIYQNEFLGCTDRLVITPLTDRCYITLAQALGMSMGGAPAGPAGTGKTETTKDMGRCLGKYVVVFNCSDQMDFRGLGRIFKGLAQSGSWGCFDEFNRIDLPVLSVAAQQISIILTCKKEHKKSFIFTDGDNVTMNPEFGLFLTMNPGYAGRQELPENLKINFRSVAMMVPDRQIIIRVKLASCGFIDNVVLARKFFTLYKLCEEQLSKQVHYDFGLRNILSVLRTLGAAKRANPMDTESTIVMRVLRDMNLSKLIDEDEPLFLSLIEDLFPNILLDKAGYPELEAAISRQVEEAGLINHPPWKLKVIQLFETQRVRHGMMTLGPSGAGKTTCIHTLMRAMTDCGKPHREMRMNPKAITAPQMFGRLDVATNDWTDGIFSTLWRKTLRAKKGEHIWIILDGPVDAIWIENLNSVLDDNKTLTLANGDRIPMAPNCKIIFEPHNIDNASPATVSRNGMVFMSSSILDWSPILEGFLKKRSPQEAEILRQLYTESFPDLYRFCIQNLEYKMEVLEAFVITQSINMLQGLIPLKEQGGEVSQAHLGRLFVFALLWSAGAALELDGRRRLELWLRSRPTGTLELPPPAGPGDTAFDYYVAPDGTWTHWNTRTQEYLYPSDTTPEYGSILVPNVDNVRTDFLIQTIAKQGKAVLLIGEQGTAKTVIIKGFMSKYDPECHMIKSLNFSSATTPLMFQRTIESYVDKRMGTTYGPPAGKKMTVFIDDVNMPIINEWGDQVTNEIVRQLMEQNGFYNLEKPGEFTSIVDIQFLAAMIHPGGGRNDIPQRLKRQFSIFNCTLPSEASVDKIFGVIGVGHYCTQRGFSEEVRDSVTKLVPLTRRLWQMTKIKMLPTPAKFHYVFNLRDLSRVWQGMLNTTSEVIKEPNDLLKLWKHECKRVIADRFTVSSDVTWFDKALVSLVEEEFGEEKKLLVDCGIDTYFVDFLRDAPEAAGETSEEADAETPKIYEPIESFSHLKERLNMFLQLYNESIRGAGMDMVFFADAMVHLVKISRVIRTPQGNALLVGVGGSGKQSLTRLASFIAGYVSFQITLTRSYNTSNLMEDLKVLYRTAGQQGKGITFIFTDNEIKDESFLEYMNNVLSSGEVSNLFARDEIDEINSDLASVMKKEFPRCLPTNENLHDYFMSRVRQNLHIVLCFSPVGEKFRNRALKFPALISGCTIDWFSRWPKDALVAVSEHFLTSYDIDCSLEIKKEVVQCMGSFQDGVAEKCVDYFQRFRRSTHVTPKSYLSFIQGYKFIYGEKHVEVRTLANRMNTGLEKLKEASESVAALSKELEAKEKELQVANDKADMVLKEVTMKAQAAEKVKAEVQKVKDRAQAIVDSISKDKAIAEEKLEAAKPALEEAEAALQTIRPSDIATVRTLGRPPHLIMRIMDCVLLLFQRKVSAVKIDLEKSCTMPSWQESLKLMTAGNFLQNLQQFPKDTINEEVIEFLSPYFEMPDYNIETAKRVCGNVAGLCSWTKAMASFFSINKEVLPLKANLVVQENRHLLAMQDLQKAQAELDDKQAELDVVQAEYEQAMTEKQTLLEDAERCRHKMQTASTLISGLAGEKERWTEQSQEFAAQTKRLVGDVLLATAFLSYSGPFNQEFRDLLLNDWRKEMKARKIPFGKNLNLSEMLIDAPTISEWNLQGLPNDDLSIQNGIIVTKASRYPLLIDPQTQGKIWIKNKESRNELQITSLNHKYFRNHLEDSLSLGRPLLIEDVGEELDPALDNVLERNFIKTGSTFKVKVGDKEVDVLDGFRLYITTKLPNPAYTPEISARTSIIDFTVTMKGLEDQLLGRVILTEKQELEKERTHLMEDVTANKRRMKELEDNLLYRLTSTQGSLVEDESLIVVLSNTKRTAEEVTQKLEISAETEVQINSAREEYRPVATRGSILYFLITEMRLVNEMYQTSLRQFLGLFDLSLARSVKSPITSKRIANIIEHMTYEVYKYAARGLYEEHKFLFTLLLTLKIDIQRNRVKHEEFLTLIKGGASLDLKACPPKPSKWILDITWLNLVELSKLRQFSDVLDQISRNEKMWKIWFDKENPEEEPLPNAYDKSLDCFRRLLLIRSWCPDRTIAQARKYIVDSMGEKYAEGVILDLEKTWEESDPRTPLICLLSMGSDPTDSIIALGKRLKIETRYVSMGQGQEVHARKLLQQTMANGGWALLQNCHLGLDFMDELMDIIIETELVHDAFRLWMTTEAHKQFPITLLQMSIKFANDPPQGLRAGLKRTYSGVSQDLLDVSSGSQWKPMLYAVAFLHSTVQERRKFGALGWNIPYEFNQADFNATVQFIQNHLDDMDVKKGVSWTTIRYMIGEIQYGGRVTDDYDKRLLNTFAKVWFSENMFGPDFSFYQGYNIPKCSTVDNYLQYIQSLPAYDSPEVFGLHPNADITYQSKLAKDVLDTILGIQPKDTSGGGDETREAVVARLADDMLEKLPPDYVPFEVKERLQKMGPFQPMNIFLRQEIDRMQRVLSLVRSTLTELKLAIDGTIIMSENLRDALDCMFDARIPAWWKKASWISSTLGFWFTELIERNSQFTSWVFNGRPHCFWMTGFFNPQGFLTAMRQEITRANKGWALDNMVLCNEVTKWMKDDISAPPTEGVYVYGLYLEGAGWDKRNMKLIESKPKVLFELMPVIRIYAENNTLRDPRFYSCPIYKKPVRTDLNYIAAVDLRTAQTPEHWVLRGVALLCDVK

SEQ ID NO: 44450 - protein, 4158 aa, Homo sapiens
MTFRATDSEFDLTNIEEYAENSALSRLNNIKAKQRVSYVTSTENESDTQILTFRHITKAQEKTRKRQQPIKLEPLPVLKVYQDHKQPEYIHEQNRFQLMTAGIIKRPVSIAKKSFATSSTQFLEHQDAVKKMQIHRPYVEVFSPSPPKLPHTGIGKRGLFGTRSSAYPKYTFHDREEVVKANIRDPLQIIKIIRENEHLGFLYMIPAVPRSSIEYDTYNLKVVSYENINKNDYYTISQRAVTHIYNEDIEFIEIDRWEQEYLYHRELTKIPIFSLFRKWKAFSVWRKNVRSKKITGCQKSLQKNLFIVNPHLRPALLKINELCYHLSFMGLCYIEKCHTYTLQEFKAAQVIRLAEVTERLGEFRNEAKYVVRRACRFALRAAGFVPDDCAFGPFEDYHKVQSSGSFINTPHELPTYGDSEKMTYTEQASKRHYCMRLTCFIRLNDYLIENTMHILTVNAVNSLLNHLTDKLKRTPSADVIQKWITEEKPEVPDKKGTLMVEKQEEDESLIPMFLTELMLTVQSLLFEPSLEDFLDGILGAVNHCQNTVLSVPNLVPDSYFDAFTSPYINNKLEGKTCGTGPSLAAVFEDDKNFHTIISQIKETIQAAFESARIYAATFEKFQIFFKENESLDLQALKLQEPDINFFSEQLEKYHKQHKDAVALRPTRNVGLLLIDTRLLREKLIPSPLRCLEVLNFMLPRQSKKKVDAIIFEAQDAEYKLEFVPTTTTEYVHSLLFLDEIQERIESLEDEGNIVTQMYKLMEQYQVPTPPEDFAVFATMKPSIVAVRNAIDKSVGDRESSIKQFCVHLGSDLEELNNEVNEVKLQAQDPQILDISADQDKIRLILNNLQSVLADLQKRAFQYKSYQKNFKVEVSKFEALEEVSAELKLKQLLWDSFSEWDKLQQEWLKSKFDCLDPEVLNGQVSKYAKFVTQLEKGLPPNSVVPQLKYKVEKMKEKLPVIIDLRNPTLKARHWAAIEQTVDATLVDAEIPLTLERLSQLHVFDFGQEIQDISGQASGEAALEAILKKVEDSWKTTEFVILPHRDSKDVFILGGTDDIQVLLDDSTINVATLASSRYLGPLKTRVDEWQKQLALFNQTLEEWLTCQRNWLYLESIFNAPDIQRQLPAEAKMFLQVDKSWKEIMRKVNRLPNALRAATQPGLLETFQNNNALLDQIQKCLEAYLESKRVIFPRFYFLSNDELLEILAQTRNPQAVQPHLRKCFDSISKLEFALMPPAEGKIPGIDGEPEKVYTNDILAMLSPEGERVSLGKGLKARGNVEEWLGKVEEAMFTSLRRLCKAAIADYQGKLRTDWVVAGHPSQVILTVSQIMWCRDLTECLETEHSNHIQALKNFEKVNFERLNALAAIVQGSLPKLHRNILTALITIDVHARDIVTELVQSKVETVESFDWQRQLRYYWDIDLDNCVARMALSQYTYGYEYLGACPRLVITPLTDRCYLCLMGALQLDLGGAPAGPAGTGKTETTKDLAKALAIQCVVFNCSDGLDYKMMGRFFSGLAQSGAWCCFDEFNRIDIEVLSVIAQQLITIRNAKAAKLSRFMFEGREIKLVMTCAAFITMNPGYAGRTELPDNLKALFRPFAMMVPNYALIAEVILYSEGFESSKILARKMTQMYKLCSEQLSQQDHYDFGMRAVKSVLVMAGSLKRENPDLNEDVVLIRALQDSNLPKFLTDDALLFSGIISDLFPGVQIPEHDYGILQSTIVDVMNRQNLQPEMCMVRKVIQFYETMLVRHGVMLVGPTGGGKTTVYRILAETLGNLQKLGIENSFYQAVKTYVLNPKSITMGELYGEVNNLTLEWKDGLMALSVRAAVNDTSEDHKWIISDGPVDALWIENMNTVLDDNKMLCLANSERIKLTPQIHMLFEVQDLRVASPATVSRCGMVFVDPEELKWMPYVKTWMKGISKKLTEETQEYILNLFQRYVDEGLHFINKKCSQAIPQVDISKVTTLCCLLESLILGKDGVNLAMEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQAILNGFLSDFPPAVKQTASSIVEASVEIYNKMSVDLLPTPAKSHYVFNLRDLSKCVQGILQCDPGTIREEIQIFRLFCHECQRVFHDRLINNEDKHYFHVILTEMANKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVFQYFISKVRQKLHIVLCMSPVGEAFRSRCRMFPSLVNCCTIDWFVQWPREALLSVSKTFFSQVDAGNEELKEKLPLMCVNVHLSVSSMAERYYNELRRRYYTTPTSYLELINLYLSMLSEKRKQIISARDRVKNGLTKLLETNILVDKMKLDLSALEPVLLAKSEDVEALMEKLAVDQESADQVRNTVQEDEATAKVKAEETQAIADDAQRDLDEALPALDAANKALDSLDKADISEIRVFTKPPDLVMTVMEAISILLNAKPDWPSAKQLLGDSNFLKRLLEYDKENIKPQILAKLQKYINNPDFVPEKVEKVSKACKSMCMWVRAMDLYSRVVKVVEPKRQKLRAAQAELDITMATLREKQALLRQVEDQIQALQDEYDKGVNEKESLAKTMALTKARLVRAGKLTAALEDEQVRWEESIQKFEEEISNITGNVFIAAACVAYYGAFTAQYRQSLIECWIQDCQSLEIPIDPSFSLINILGDPYEIRQWNTDGLPRDLISTENGILVTQGRRWPLMIDPQDQANRWIRNKESKSGLKIIKLTDSNFLRILENSIRLGLPVLLEELKETLDPALEPILLKQIFISGGRLLIRLGDSDIDYDKNFRFYMTTKMPNPHYLPEVCIKVTIINFTVTKSGLEDQLLSDVVRLEKPRLEEQRIKLIVRINTDKNQLKTIEEKILRMLFTSEGNILDNEELIDTLQDSKITSGAIKTRLEEAESTEQMINVAREKYRPVATQGSVMYFVIASLSEIDPMYQYSLKYFKQLFNTTIETSVKTENLQQRLDVLLEQTLLTAYVNVSRGLFEQHKLIYSFMLCVEMMRQQGTLSDAEWNFFLRGSAGLEKERPPKPEAPWLPTATWFACCDLEESFPVFHGLTQNILSHPISIRLGSFETYINPQKWEGYSKMKHEDKHMRQEKEAAHQDPWSAGLSSFHKLILIKCCKEEKVVFALTDFVIENLGKQFIETPPVDLPTLYQDMSCNTPLVFILSTGSDPMGAFQRFARESGYSERVQSISLGQGQGPIAEKMVKDAMKSGNWVFLQNCHLAVSWMLAMEELIKTFTDPDSAIKDTFRLFLSSMPSNTFPVTVLQNSVKVTNEPPKGLRANIRRAFTEMTPSFFEENILGKKWRQIIFGICFFHAIIQERKKFGPLGWNICYEFNDSDRECALLNLKLYCKEGKIPWDALIYITGEITYGGRVTDSWDQRCLRTILKRFFSPETLEEDYKYSESGIYFAPMADSLQEFKDYIENLPLIDDPEIFGMHENANLVFQYKETSTLINTILEVQPRSSTGGEGKSNDEIVQELVASVQTRVPEKLEMEGASESLFVKDLQGRLNSLTTVLGQEVDRFNNLLKLIHTSLETLNKAIAGFVVMSEEMEKVYNSFLNNQVPALWSNTAYPSLKPLGSWVKDLILRTSFVDLWLKRGQPKSYWISGFFFPQGFLTGTLQNHARKYNLPIDELSFKYSVIPTYRDQAAVIEAAKTVQFGQELPMDMELPSPEDGVLVHGMFMDASRWDDKEMVIEDALPGQMNPVLPVVHFEPQQNYKPSPTLYHCPLYKTGARAGTLSTTGHSTNFVVTVLLPSKRSKDYWIAKGSALLCQLSE

SEQ ID NO: 44451 - protein, 4158 aa, Homo sapiens; identical to SEQ ID NO: 44450

SEQ ID NO: 44452 - protein, 2530 aa, Homo sapiens
MTFRATDSEFDLTNIEEYAENSALSRLNNIKAKQRVSYVTSTENESDTQILTFRHITKAQEKTRKRQQPIKLEPLPVLKVYQDHKQPEYIHEQNRFQLMTAGIIKRPVSIAKKSFATSSTQFLEHQDAVKKMQIHRPYVEVFSPSPPKLPHTGIGKRGLFGTRSSAYPKYTFHDREEVVKANIRDPLQIIKIIRENEHLGFLYMIPAVPRSSIEYDTYNLKVVSYENINKNDYYTISQRAVTHIYNEDIEFIEIDRWEQEYLYHRELTKIPIFSLFRKWKAFSVWRKNVRSKKITGCQKSLQKNLFIVNPHLRPALLKINELCYHLSFMGLCYIEKCHTYTLQEFKAAQVIRLAEVTERLGEFRNEAKYVVRRACRFALRAAGFVPDDCAFGPFEDYHKVQSSGSFINTPHELPTYGDSEKMTYTEQASKRHYCMRLTCFIRLNDYLIENTMHILTVNAVNSLLNHLTDKLKRTPSADVIQKWITEEKPEVPDKKGTLMVEKQEEDESLIPMFLTELMLTVQSLLFEPSLEDFLDGILGAVNHCQNTVLSVPNLVPDSYFDAFTSPYINNKLEGKTCGTGPSLAAVFEDDKNFHTIISQIKETIQAAFESARIYAATFEKFQIFFKENESLDLQALKLQEPDINFFSEQLEKYHKQHKDAVALRPTRNVGLLLIDTRLLREKLIPSPLRCLEVLNFMLPRQSKKKVDAIIFEAQDAEYKLEFVPTTTTEYVHSLLFLDEIQERIESLEDEGNIVTQMYKLMEQYQVPTPPEDFAVFATMKPSIVAVRNAIDKSVGDRESSIKQFCVHLGSDLEELNNEVNEVKLQAQDPQILDISADQDKIRLILNNLQSVLADLQKRAFQYKSYQKNFKVEVSKFEALEEVSAELKLKQLLWDSFSEWDKLQQEWLKSKFDCLDPEVLNGQVSKYAKFVTQLEKGLPPNSVVPQLKYKVEKMKEKLPVIIDLRNPTLKARHWAAIEQTVDATLVDAEIPLTLERLSQLHVFDFGQEIQDISGQASGEAALEAILKKVEDSWKTTEFVILPHRDSKDVFILGGTDDIQVLLDDSTINVATLASSRYLGPLKTRVDEWQKQLALFNQTLEEWLTCQRNWLYLESIFNAPDIQRQLPAEAKMFLQVDKSWKEIMRKVNRLPNALRAATQPGLLETFQNNNALLDQIQKCLEAYLESKRVIFPRFYFLSNDELLEILAQTRNPQAVQPHLRKCFDSISKLEFALMPPAEGKIPGIDGEPEKVYTNDILAMLSPEGERVSLGKGLKARGNVEEWLGKVEEAMFTSLRRLCKAAIADYQGKLRTDWVVAGHPSQVILTVSQIMWCRDLTECLETEHSNHIQALKNFEKVNFERLNALAAIVQGSLPKLHRNILTALITIDVHARDIVTELVQSKVETVESFDWQRQLRYYWDIDLDNCVARMALSQYTYGYEYLGACPRLVITPLTDRCYLCLMGALQLDLGGAPAGPAGTGKTETTKDLAKALAIQCVVFNCSDGLDYKMMGRFFSGLAQSGAWCCFDEFNRIDIEVLSVIAQQLITIRNAKAAKLSRFMFEGREIKLVMTCAAFITMNPGYAGRTELPDNLKALFRPFAMMVPNYALIAEVILYSEGFESSKILARKMTQMYKLCSEQLSQQDHYDFGMRAVKSVLVMAGSLKRENPDLNEDVVLIRALQDSNLPKFLTDDALLFSGIISDLFPGVQIPEHDYGILQSTIVDVMNRQNLQPEMCMVRKVIQFYETMLVRHGVMLVGPTGGGKTTVYRILAETLGNLQKLGIENSFYQAVKTYVLNPKSITMGELYGEVNNLTLEWKDGLMALSVRAAVNDTSEDHKWIISDGPVDALWIENMNTVLDDNKMLCLANSERIKLTPQIHMLFEVQDLRVASPATVSRCGMVFVDPEELKWMPYVKTWMKGISKKLTEETQEYILNLFQRYVDEGLHFINKKCSQAIPQVDISKVTTLCCLLESLILGKDGVNLAMEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQAILNGFLSDFPPAVKQTASSIVEASVEIYNKMSVDLLPTPAKSHYVFNLRDLSKCVQDKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVGCARVVMWLYHKNVSSPFI

SEQ ID NO: 44453 - protein, 4695 aa, Homo sapiens
GAEAPPSTEEAAPPRSEEEEAPRPPTVEAPAEDGFSPSAEDAVSSVVDYRDLIPSEEGIVLPDDHEADLNRVRQRLAPRPVQSVISEVLSLPSSRRSSRYRRSMSGLPNLQETLKERQARFREARESRRLKIDPSYKYIFEILAENLGLDIVTVEELILDCPSLEAFTNFFAKDGCKTLKFLYQEGDVPGIECGRTIAGATKGAKMMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 44454 - protein, 4490 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 44455 - protein, 4454 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 44456 - protein, 4188 aa, Homo sapiens
MEKDAEDGAPSEGAEAPPSTEEAAPPRSEEEEAPRPPTVEAPAEDGFSPSAEDAVSSVVDYRDLIPSEEGIVLPDDHEADLNRVRQRLAPRPVQSVISEVLSLPSSRRSSRYRRSMSGLPNLQETLKERQARFREARESRRLKIDPSYKYIFEILAENLGLDIVTVEELILDCPSLEAFTNFFAKDGCKTLKFLYQEGDVPGIECGRTIAGATKGAKMMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQVCDKRLLLLQHYC

SEQ ID NO: 44457 - protein, 4486 aa, Homo sapiens
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGQLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 44458 - protein, 333 aa, Homo sapiens
MKDFVLGRDKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQVKRCSFFTFYHPAHCLEHSRH

SEQ ID NO: 44459 - protein, 798 aa, Homo sapiens
MNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 44460 - protein, 2992 aa, Homo sapiens
EVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 44461 - protein, 4410 aa, Homo sapiens
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGQLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 44462 - protein, 699 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 44463 - protein, 194 aa, Homo sapiens
MDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKEKKGQEVQKGPAVEIAKLDKLLNLVREVKIKT

SEQ ID NO: 44464 - protein, 289 aa, Homo sapiens
MIPASAKAPHKQPHKQDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQ

SEQ ID NO: 44465 - protein, 289 aa, Homo sapiens; identical to SEQ ID NO: 44464

SEQ ID NO: 44466 - protein, 142 aa, Homo sapiens
  MOD_RES (1)..(1): Any amino acid
XCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKEKKGQEVQKGPAVEIAKLDKLLNLVREVKIKT

SEQ ID NO: 44467 - protein, 168 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKKQWSLGFIPKLKRKIPVNYWGQDEGEISNETVRVIYSLGIFIMKIVTILLNINIEHLLCVRHCVNRLFLLFLILIIIMQIR

SEQ ID NO: 44468 - protein, 402 aa, Homo sapiens
MRTTLTPSCSSALDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKAATKSRRRPGGGGGRGSSGGRRG

SEQ ID NO: 44469 - protein, 605 aa, Homo sapiens
MEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFAELKKKEADAIKLTPVPQQPSPEEDQVVEEGEEAAGEEGDEEVEEDLA

SEQ ID NO: 44470 - protein, 605 aa, Homo sapiens; identical to SEQ ID NO: 44469

SEQ ID NO: 44471 - protein, 77 aa, Homo sapiens
MKKLKILYMSNNLVKDWAEFVKLAELPCLEDLVFVGNPLEEKHSAENNWIEEATKRVPKLKKLDGTPVIKGDEEEDN

SEQ ID NO: 44472 - protein, 151 aa, Homo sapiens
MDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 44473 - protein, 190 aa, Homo sapiens
MAKATTIKEALARWEEKTGQRPSEAKEIKLYAQIPPIEKMDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 44474 - protein, 57 aa, Homo sapiens
MKKLKILYMSNNLVKDWAEFVKLAELPCLEDLVFVGNPLEEKHSAENNWIEEATKRV

SEQ ID NO: 44475 - protein, 151 aa, Homo sapiens; identical to SEQ ID NO: 44472

SEQ ID NO: 44476 - protein, 64 aa, Homo sapiens
MKKLKILYMSNNLVKDWAEFVKLAELPCLEDLVFVGNPLEEKHSAENNWIEEATKRVPKLKKLD

SEQ ID NO: 44477 - protein, 52 aa, Homo sapiens
MDASLSMLANCEKLSLSTNCIEKIANLNGLKNLRILSLGRNNIKNLNGLEAV

SEQ ID NO: 44478 - protein, 65 aa, Homo sapiens
MKKLKILYMSNNLVKDWAEFVKLAELPCLEDLVFVGNPLEEKHSAENNWIEEATKRVPKLKKLDG

SEQ ID NO: 44479 - protein, 280 aa, Homo sapiens
MVTANKAHTGQGSCWVATLASAMIPPADSLLKYDTPVLVSRNTEKRSPKARLLKVSPQQPGPSGSAPQPPKTKLPSTPCVPDPTKQAEEILNAILPPREWVEDTQLWIQQVSSTPSTRMDVVHLQEQLDLKLQQRQARETGICPVRRELYSQCFDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 44480 - protein, 132 aa, Homo sapiens
MPYYPQDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 44481 - protein, 4646 aa, Homo sapiens [sequence omitted]

SEQ ID NO: 44482 - protein, 632 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 44483 - protein, 612 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 44484 - protein, 630 aa, Homo sapiens
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 44485 - protein, 638 aa, Homo sapiens
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 44486 - protein, 612 aa, Homo sapiens; identical to SEQ ID NO: 44483

SEQ ID NO: 44487 - protein, 632 aa, Homo sapiens; identical to SEQ ID NO: 44482

SEQ ID NO: 44488 - protein, 637 aa, Homo sapiens
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEIAVPRNDEWARFGRTLAEINANRADAEEEAATRIPA

SEQ ID NO: 44489 - protein, 638 aa, Homo sapiens; identical to SEQ ID NO: 44485

SEQ ID NO: 44490 - protein, 611 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEIAVPRNDEWARFGRTLAEINANRADAEEEAATRIPA

SEQ ID NO: 44491 - protein, 638 aa, Homo sapiens
MSDKSELKAELERKKQRLAQIREEKKRKEEERKKKETDQKKEAVAPVQEESDLEKKRREAEALLQSMGLTPESPIDIAEYLVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 44492 - protein, 920 aa, Homo sapiens
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 44493 - protein, 4307 aa, Homo sapiens
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQGFQASDMHAWKQHWNHQLYKALEHQYQMGLEALNENLPEINIDLTYKQGRLQFRPPFEEIRAKYYREMKRFIGIPNQFKGVGEAGDESIFSIMIDRNASGFLTIFSKAEDLFRRLSAVLHQHKEWIVIGQVDMEALVEKHLFTVHDWEKNFKALKIKGKEVERLPSAVKVDCLNINCNPVKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKLIKEKKIEFDDLEVTRKKLVDDCHHFRLEEPNFSLASSISKDIESCAQIWAFYEEFQQGFQEMANEDWITFRTKTYLFEEFLMNWHDRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRSIMTDIKKDNRVTTLTTHAGIRNSLLTILDQLQRCQKSLNEFLEEKRSAFPRFYFIGDDDLLEILGQSTNPSVIQSHLKKLFAGINSVCFDEKSKHITAMKSLEGEVVPFKNKVPLSNNVETWLNDLALEMKKTLEQLLKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGNASKLVYTPLTDKCYLTLTQAMKMGLGGNPYGPAGTGKTESVKALGGLLGRQVLVFNCDEGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDWGLRALKTVLRGSGNLLRQLNKSGTTQNANESHIVVQALRLNTMSKFTFTDCTRFDALIKDVFPGIELKEVEYDELSAALKQVFEEANYEIIPNQIKKALELYEQLCQRMGVVIVGPSGAGKSTLWRMLRAALCKTGKVVKQYTMNPKAMPRYQLLGHIDMDTREWSDGVLTNSARQVVREPQDVSSWIICDGDIDPEWIESLNSVLDDNRLLTMPSGERIQFGPNVNFVFETHDLSCASPATISRMGMIFLSDEETDLNSLIKSWLRNQPAEYRNNLENWIGDYFEKALQWVLKQNDYVVETSLVGTVMNGLSHLHGCRDHDEFIINLIRGLGGNLNMKSRLEFTKEVFHWARESPPDFHKPMDTYYDSTRGRLATYVLKKPEDLTADDFSNGLTLPVIQTPDMQRGLDYFKPWLSSDTKQPFILVGPEGCGKGMLLRYAFSQLRSTQIATVHCSAQTTSRHLLQKLSQTCMVISTNTGRVYRPKDCERLVLYLKDINLPKLDKWGTSTLVAFLQQVLTYQGFYDENLEWVGLENIQIVASMSAGGRLGRHKLTTRFTSIVRLCSIDYPEREQLQTIYGAYLEPVLHKNLKNHSIWGSSSKIYLLAGSMVQVYEQVRAKFTVDDYSHYFFTPCILTQWVLGLFRYDLEGGSSNHPLDYVLEIVAYEARRLFRDKIVGAKELHLFDIILTSVFQGDWGSDILDNMSDSFYVTWGARHNSGARAAPGQPLPPHGKPLGKLNSTDLKDVIKKGLIHYGRDNQNLDILLFHEVLEYMSRIDRVLSFPGGSLLLAGRSGVGRRTITSLVSHMHGAVLFSPKISRGYELKQFKNDLKHVLQLAGIEAQQVVLLLEDYQFVHPTFLEMINSLLSSGEVPGLYTLEELEPLLLPLKDQASQDGFFGPVFNYFTYRIQQNLHIVLIMDSANSNFMINCESNPALHKKCQVLWMEGWSNSSMKKIPEMLFSETGGGEKYNDKKRKEEKKKNSVDPDFLKSFLLIHESCKAYGATPSRYMTFLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWVSMKSFLAKRGVREDIATFDARNISKEIRESVEELLFKNKGSFDPKNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQVVEITEELATLPKRAQLAAAFITYLSAAPESLRKTCLEEWTKSAGLEKFDLRRFLCTESEQLIWKSEGLPSDDLSIENALVILQSRVCPFLIDPSSQATEWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFLRLFQRALQNKQDSENTEQRIQSLISSLQHMVYEYICRCLFKADQLMFALHFVRGMHPELFQENEWDTFTGVVVGDMLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQNSNLIHQKVPPPNDRQGSPILSFIILEQFNAIRLVQSVHQSLAALSKVIRGTTLLSSEVQKLASALLNQKCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 44494 - protein, 4314 aa, Homo sapiens
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQGFQASDMHAWKQHWNHQLYKALEHQYQMGLEALNENLPEINIDLTYKQGRLQFRPPFEEIRAKYYREMKRFIGIPNQFKGVGEAGDESIFSIMIDRNASGFLTIFSKAEDLFRRLSAVLHQHKEWIVIGQVDMEALVEKHLFTVHDWEKNFKALKIKGKEVERLPSAVKVDCLNINCNPVKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKLIKEKKIEFDDLEVTRKKLVDDCHHFRLEEPNFSLASSISKDIESCAQIWAFYEEFQQGFQEMANEDWITFRTKTYLFEEFLMNWHDRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRSIMTDIKKDNRVTTLTTHAGIRNSLLTILDQLQRCQKSLNEFLEEKRSAFPRFYFIGDDDLLEILGQSTNPSVIQSHLKKLFAGINSVCFDEKSKHITAMKSLEGEVVPFKNKVPLSNNVETWLNDLALEMKKTLEQLLKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGNASKLVYTPLTDKCYLTLTQAMKMGLGGNPYGPAGTGKTESVKALGGLLGRQVLVFNCDEGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDWGLRALKTVLRGSGNLLRQLNKSGTTQNANESHIVVQALRLNTMSKFTFTDCTRFDALIKDVFPGIELKEVEYDELSAALKQVFEEANYEIIPNQIKKALELYEQLCQRMGVVIVGPSGAGKSTLWRMLRAALCKTGKVVKQYTMNPKAMPRYQLLGHIDMDTREWSDGVLTNSARQVVREPQDVSSWIICDGDIDPEWIESLNSVLDDNRLLTMPSGERIQFGPNVNFVFETHDLSCASPATISRMGMIFLSDEETDLNSLIKSWLRNQPAEYRNNLENWIGDYFEKALQWVLKQNDYVVETSLVGTVMNGLSHLHGCRDHDEFIINLIRGLGGNLNMKSRLEFTKEVFHWARESPPDFHKPMDTYYDSTRGRLATYVLKKPEDLTADDFSNGLTLPVIQTPDMQRGLDYFKPWLSSDTKQPFILVGPEGCGKGMLLRYAFSQLRSTQIATVHCSAQTTSRHLLQKLSQTCMVISTNTGRVYRPKDCERLVLYLKDINLPKLDKWGTSTLVAFLQQVLTYQGFYDENLEWVGLENIQIVASMSAGGRLGRHKLTTRFTSIVRLCSIDYPEREQLQTIYGAYLEPVLHKNLKNHSIWGSSSKIYLLAGSMVQVYEQVRAKFTVDDYSHYFFTPCILTQWVLGLFRYDLEGGSSNHPLDYVLEIVAYEARRLFRDKIVGAKELHLFDIILTSVFQGDWGSDILDNMSDSFYVTWGARHNSGARAAPGQPLPPHGKPLGKLNSTDLKDVIKKGLIHYGRDNQNLDILLFHEVLEYMSRIDRVLSFPGGSLLLAGRSGVGRRTITSLVSHMHGAVLFSPKISRGYELKQFKNDLKHVLQLAGIEAQQVVLLLEDYQFVHPTFLEMINSLLSSGEVPGLYTLEELEPLLLPLKDQASQDGFFGPVFNYFTYRIQQNLHIVLIMDSANSNFMINCESNPALHKKCQVLWMEGWSNSSMKKIPEMLFSETGGGEKYNDKKRKEEKKKNSVDPDFLKSFLLIHESCKAYGATPSRYMTFLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWVSMKSFLAKRGVREDIATFDARNISKEIRESVEELLFKNKGSFDPKNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQVVEITEELATLPKRAQLAAAFITYLSAAPESLRKTCLEEWTKSAGLEKFDLRRFLCTESEQLIWKSEGLPSDDLSIENALVILQIIGLKSWSRVCPFLIDPSSQATEWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFLRLFQRALQNKQDSENTEQRIQSLISSLQHMVYEYICRCLFKADQLMFALHFVRGMHPELFQENEWDTFTGVVVGDMLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQNSNLIHQKVPPPNDRQGSPILSFIILEQFNAIRLVQSVHQSLAALSKVIRGTTLLSSEVQKLASALLNQKCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 44495 - protein, 504 aa, Homo sapiens [sequence omitted]

SEQ ID NO: 44496 - protein, 89 aa, Homo sapiens
MCDRKAVIKNADMSEEMQQDSVECATQALEKYNIEKDIAAHIKKEFDKKYNPTWHCIVGRNFGSYVTHETKHFIYFYLGQVAILLFKSG

SEQ ID NO: 44497 - protein, 89 aa, Homo sapiens; identical to SEQ ID NO: 44496

SEQ ID NO: 44498 - protein, 89 aa, Homo sapiens; identical to SEQ ID NO: 44496

SEQ ID NO: 44499 - protein, 89 aa, Homo sapiens; identical to SEQ ID NO: 44496

SEQ ID NO: 44500 - protein, 42 aa, Homo sapiens
MCDRKAVIKNADMSEEMQQDSVECATQALEKYNIEKDIAAHI

SEQ ID NO: 44501 - protein, 89 aa, Homo sapiens; identical to SEQ ID NO: 44496

SEQ ID NO: 44502 - protein, 89 aa, Homo sapiens
MSDRKAVIKNADMSEDMQQDAVDCATQAMEKYNIEKDIAAYIKKEFDKKYNPTWHCIVGRNFGSYVTHETKHFIYFYLGQVAILLFKSG

SEQ ID NO: 44503 - protein, 47 aa, Homo sapiens
MAEVEETLKRLQSQKGVQGIIVVNTEGGWEPLGHCGDRSRPPAQGCP

SEQ ID NO: 44504 - protein, 96 aa, Homo sapiens
MAEVEETLKRLQSQKGVQGIIVVNTEGIPIKSTMDNPTTTQYASLMHSFILKARSTVRDIDPQNDLTFLRIRSKKNEIMVAPDKDYFLIVIQNPTE

SEQ ID NO: 44505 - protein, 121 aa, Homo sapiens
MAEVEETLKRLQSQKGVQGIIVVNTEGIPIKSTMDNPTTTQYASLMHSFILKARSTVRDIDPQNDLTFLRIRSKKNEIMVAPGKGSSTSPCRNRPHGTFSVAHQESWHSGVSRGSKQGPRS

SEQ ID NO: 44506 - protein, 96 aa, Homo sapiens
MAEVEETLKRIQSHKGVIGTMVVNAEGIPIRTTLDNSTTVQYAGLLHHLTMKAKSTVRDIDPQNDLTFLRIRSKKHEIMVAPDKEYLLIVIQNPCE

SEQ ID NO: 44507 - protein, 54 aa, Homo sapiens
MAEVEETLKRIQSHKGVIGTMVVNAEDPRFVTFKYARQLTAFQRKSGQQITIKD

SEQ ID NO: 44508 - protein, 161 aa, Homo sapiens
MDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 44509 - protein, 161 aa, Homo sapiens; identical to SEQ ID NO: 44508

SEQ ID NO: 44510 - protein, 263 aa, Homo sapiens
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 44511 - protein, 161 aa, Homo sapiens; identical to SEQ ID NO: 44508

SEQ ID NO: 44512 - protein, 112 aa, Homo sapiens
MDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 44513 - protein, 259 aa, Homo sapiens
MGAGNFLTALEVPVAALAGAASDRRASCERVSPPPPLPHFRLPPLPRSRLPGPVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 44514 - protein, 112 aa, Homo sapiens; identical to SEQ ID NO: 44512

SEQ ID NO: 44515 - protein, 161 aa, Homo sapiens; identical to SEQ ID NO: 44508

SEQ ID NO: 44516 - protein, 172 aa, Homo sapiens
  MOD_RES (1)..(1): Any amino acid
XTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 44517 - protein, 5171 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44518 - protein, 4200 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQDVGTGYCRSSEQYKCHE

SEQ ID NO: 44519 - protein, 7461 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44520 - protein, 7750 aa, Homo sapiens
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKANNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRVSFQSNFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44521 - protein, 2649 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 44522 - protein, 7572 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKANNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRVSFQSNFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44523 - protein, 5457 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLLREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRVSFQSNFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44524 - protein, 3060 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQ

SEQ ID NO: 44525 - protein, 7246 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKANNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRVSFQSNFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 44526 - protein, 255 aa, Homo sapiens
MNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSMGFSK

SEQ ID NO: 44527 - protein, 452 aa, Homo sapiens
MFPDQPEKPLNLAHIVPPRPVTSMNDTLFSHSVPSSGSPFITRRLPEGISASSPVAEEHSLIKLYVNQLDHGARSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44528 - protein, 371 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSDGAFGGCV

SEQ ID NO: 44529 - protein, 395 aa, Homo sapiens
MFPDQPEKPLNLAHIVPPRPVTSMNDTLFSHSVPSSGSPFITRRLPEGISASSPVAEEHSLIKLYVNQLDHGARMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44530 - protein, 724 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQLHVSTETRLEHPCPVSETKWRVLFWGFVFFGGFLSLALQIYFWGLF

SEQ ID NO: 44531 - protein, 303 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGRVDKLALAEPGQYRCHSPPKVRRENHLPVTYA

SEQ ID NO: 44532 - protein, 351 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 44533 - protein, 352 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELEVTFRSELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 44534 - protein, 270 aa, Homo sapiens
MLSAHWEKKKTSLVELQEQLQQLPALIADLESMTANLTHLEASFEEVENNLLHLEDLCGQCELERCKHMQSQQLENYKKNKRRRLRTFKTELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 44535 - protein, 303 aa, Homo sapiens
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKSKELGTGKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGRVDKLALAEPGQYRCHSPPKVRRENHLPVTYA

SEQ ID NO: 44536 - protein, 44 aa, Homo sapiens
MLETLRERLLSVQQDFTSGLKTLSDKSREAKVKSKPSWLNQEQF

SEQ ID NO: 44537 - protein, 208 aa, Homo sapiens
MLETLRERLLSVQQDFTSGLKTLSDKSREAKVKSKPRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERRGDP

SEQ ID NO: 44538 - protein, 744 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVLDNMPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44539 - protein, 570 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 44540 - protein, 686 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44541 - protein, 374 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSDGAFGGCV

SEQ ID NO: 44542 - protein, 567 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 44543 - protein, 391 aa, Homo sapiens
MFPDQPEKPLNLAHIVPPRPVTSMNDTLFSHSVPSSGSPFITRSSPPKDSEVEQNKLLARAAPAFLKGKGMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44544 - protein, 743 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44545 - protein, 690 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44546 - protein, 686 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVCFRPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44547 - protein, 743 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVCFRPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 44548 - protein, 743 aa, Homo sapiens; identical to SEQ ID NO: 44544

SEQ ID NO: 44549 - protein, 391 aa, Homo sapiens; identical to SEQ ID NO: 44543

SEQ ID NO: 44550 - protein, 371 aa, Homo sapiens; identical to SEQ ID NO: 44528

SEQ ID NO: 44551 - protein, 597 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEAEARESAQATGSPHTSPTHGGGRPMPMPVRSTSAGSTPTHCPQDSLSGVGGDVQEAFAQAEEGAEEEEEKMQNGKDRG

SEQ ID NO: 44552 - protein, 188 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFG

SEQ ID NO: 44553 - protein, 132 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSV

SEQ ID NO: 44554 - protein, 149 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLR

SEQ ID NO: 44555 - protein, 597 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 44556 - protein, 560 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQAEEGAEEEEEKMQNGKDRG

SEQ ID NO: 44557 - protein, 627 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 44558 - protein, 567 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 44559 - protein, 590 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 44560 - protein, 609 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSG

SEQ ID NO: 44561 - protein, 545 aa, Homo sapiens
MIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSG

SEQ ID NO: 44562 - protein, 319 aa, Homo sapiens
MTDVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQ

SEQ ID NO: 44563 - protein, 416 aa, Homo sapiens
MLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 44564 - protein, 895 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 44565 - protein, 143 aa, Homo sapiens
MTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPALSGPPKPQSSWRDFGDFFIFIFCLTAFGLFIENSSLHF

SEQ ID NO: 44566 - protein, 88 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIA

SEQ ID NO: 44567 - protein, 15 aa, Homo sapiens
MRMSVGLSLLLPLSG

SEQ ID NO: 44568 - protein, 106 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPS

SEQ ID NO: 44569 - protein, 96 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKV

SEQ ID NO: 44570 - protein, 9 aa, Homo sapiens
MRMSVGLSL

SEQ ID NO: 44571 - protein, 117 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTL

SEQ ID NO: 44572 - protein, 52 aa, Homo sapiens
MRMSVGLSLLLPLSGRTFLLLLSVVMAQSHWPSEPSEAVRDWENQLEASMHS

SEQ ID NO: 44573 - protein, 86 aa, Homo sapiens
MRMSVGLSLLLPLSGRTFLLLLSVVMAQSHWPSEPSEAVRDWENQLEASMHSVLSDLHEAVPTVVGIPDGTAVVGRSFRVTIPTDL

SEQ ID NO: 44574 - protein, 41 aa, Homo sapiens
MRMSVGLSLLLPLSGRTFLLLLSVVMAQSHWPSEPSEAVRD

SEQ ID NO: 44575 - protein, 895 aa, Homo sapiens; identical to SEQ ID NO: 44564

SEQ ID NO: 44576 - protein, 895 aa, Homo sapiens; identical to SEQ ID NO: 44564

SEQ ID NO: 44577 - protein, 895 aa, Homo sapiens; identical to SEQ ID NO: 44564

SEQ ID NO: 44578 - protein, 895 aa, Homo sapiens; identical to SEQ ID NO: 44564

SEQ ID NO: 44579 - protein, 895 aa, Homo sapiens; identical to SEQ ID NO: 44564

SEQ ID NO: 44580 - protein, 674 aa, Homo sapiens
MAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAFTDEETEAQTGEGSWPRSPSKSVVEGISSQPGNSPSGTVV

SEQ ID NO: 44581 - protein, 629 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 44582 - protein, 655 aa, Homo sapiens
MVLPVQHVSRGAAEAAPAAGVGPGLPGAGAPARPSPGRPPGAGRLRTGPGQVRGRLLAVGPKSRVFQSVVQEPPASESRAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 44583 - protein, 639 aa, Homo sapiens
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 44584 - protein, 609 aa, Homo sapiens
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHVPRPGLSEALSLLLFAVVLSRAAALGCIGLVAHAGQLTAVWRRPGAARAP

SEQ ID NO: 44585 - protein, 530 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATGP

SEQ ID NO: 44586 - protein, 621 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPWLWASARWWGQMHRRHLLLPARVPRPGLSEALSLLLFAVVLSRAAALGCIGLVAHAGQLTAVWRRPGAARAP

SEQ ID NO: 44587 - protein, 624 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 44588 - protein, 625 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHMAPRPWLWASARWWGQAPCTAATCCSLPGSLGLAYRRRFPCSCSPLFCLVPPPWAALGWWPTPANSPQSGAAQEPPALPEP

SEQ ID NO: 44589 - protein, 42 aa, Homo sapiens
MELLQAEGATARWPPGRGCGPVPAGGARPHAPPPPAAPCQGP

SEQ ID NO: 44590 - protein, 1133 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 44591 - protein, 3685 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44592 - protein, 1230 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 44593 - protein, 622 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 44594 - protein, 3681 aa, Homo sapiens
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44595 - protein, 2344 aa, Homo sapiens
MTEMILLIFFPAYFLNAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTP

SEQ ID NO: 44596 - protein, 2341 aa, Homo sapiens
MSARKLRNLSYKKAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTP

SEQ ID NO: 44597 - protein, 617 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44598 - protein, 1225 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44599 - protein, 635 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 44600 - protein, 1243 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 44601 - protein, 3677 aa, Homo sapiens
ILDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTP

SEQ ID NO: 44602 - protein, 3562 aa, Homo sapiens
MKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLIALKDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44603 - protein, 1115 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44604 - protein, 3685 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLIALKDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 44605 - protein, 957 aa, Homo sapiens
MQPMVMQGCPYTLPRCHDWQAADQFHHSSSLRSTCPHPQVRAAVTSPAPPQDGAGVPCLSLKLLNGSVGASGPLEPPAMNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVSERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLAVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 44606 - protein, 957 aa, Homo sapiens; identical to SEQ ID NO: 44605

SEQ ID NO: 44607 - protein, 957 aa, Homo sapiens; identical to SEQ ID NO: 44605

SEQ ID NO: 44608 - protein, 879 aa, Homo sapiens
MNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVSERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLAVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 44609 - protein, 3042 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 44610 - protein, 3086 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQASTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 44611 - protein, 3159 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQASTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 44612 - protein, 3123 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQASTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 44613 - protein, 3122 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQASTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 44614 - protein, 824 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELE

SEQ ID NO: 44615 - protein, 3123 aa, Homo sapiens; identical to SEQ ID NO: 44612

SEQ ID NO: 44616 - protein, 437 aa, Homo sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 44617 - protein, 465 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 44618 - protein, 128 aa, Homo sapiens
MDKRALLASGGGGGPPAKRRLELGESGHQYLSDGLKTPKGKGRAALRSPDSPKKKTRYDTSLGLLTKKFIQLLSQSPDGVLDLNKAAEVLKVQKRRIYDITNVLEGISDLFDAYDLEKLPLVEDFMCS

SEQ ID NO: 44619 - protein, 334 aa, Homo sapiens
MPLQQQAKRRLELGESGHQYLSDGLKTPKGKGRAALRSPDSPKKKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 44620 - protein, 911 aa, Homo sapiens
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAGLNGFNVLLSGSQTPPTVGPSSGQLPSFSVPCMVLPSPPLGPFPVLYSPAMPGPVSSTLGALPNTGPVNFSLPGLGSIAQLLVGPTAVVNPKSSTLPSADPQLQSQPSLNLSPVMSRSHSVVQQPESPVYVGHPVSVVKLHQSPVPVTPKSIQRTHRETFFKTPGSLGDPVLKRRERNQSRNTSSAQRRLEIPSGGAD

SEQ ID NO: 44621 - protein, 382 aa, Homo sapiens
MQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAGLNGFNVLLSGSQTPPTVGPSSGQLPSFSVPCMVLPSPPLGPFPVLYSPAMPGPVSSTLGSIAQLLVGPTAVVNPKSSTLPSADPQLQSQPSLNLSPVMSRSHSVVQQPESPVYVGHPVSVVKLHQSPVPVTPKSIQRTHRETFFKTPGSLGDPVLKRRERNQSRNTSSAQRRLEIPSGGAD

SEQ ID NO: 44622 - protein, 728 aa, Homo sapiens
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAVTSSSDPQEHPTHTS

SEQ ID NO: 44623 - protein, 115 aa, Homo sapiens
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKD

SEQ ID NO: 44624 - protein, 867 aa, Homo sapiens
MENEKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNNDICLDEVAEELNVERRRIYDIVNVLESLHMVSRLAKNRYTWHGRHNLNKTLGTLKSIGEENKYAEQIMMIKKKEYEQEFDFIKSYSIEDHIIKSNTGPNGHPDMCFVELPGVEFRAASVNSRKDKSLRVMSQKFVMLFLVSTPQIVSLEVAAKILIGEDHVEDLDKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 44625 - protein, 867 aa, Homo sapiens
MQKKKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNNDICLDEVAEELNVERRRIYDIVNVLESLHMVSRLAKNRYTWHGRHNLNKTLGTLKSIGEENKYAEQIMMIKKKEYEQEFDFIKSYSIEDHIIKSNTGPNGHPDMCFVELPGVEFRAASVNSRKDKSLRVMSQKFVMLFLVSTPQIVSLEVAAKILIGEDHVEDLDKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 44626 - protein, 867 aa, Homo sapiens; identical to SEQ ID NO: 44624

SEQ ID NO: 44627 - protein, 784 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 44628 - protein, 348 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 44629 - protein, 371 aa, Homo sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 44630 - protein, 371 aa, Homo sapiens; identical to SEQ ID NO: 44629

SEQ ID NO: 44631 - protein, 371 aa, Homo sapiens; identical to SEQ ID NO: 44629

SEQ ID NO: 44632 - protein, 232 aa, Homo sapiens
MAATCEISNIFSNYFSAMYSSEDSTLASVPPAATFGADDLVLTLSNPQMSLEEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRD

SEQ ID NO: 44633 - protein, 663 aa, Homo sapiens
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVSSRSAPQGKGSSSWEKPKIQHVGLQPSASLELGPSLDEEIPTTSTMLVSPAEGQVKLTKAVSASSVPSNIHLGVAPVGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 44634 - protein, 663 aa, Homo sapiens; identical to SEQ ID NO: 44633

SEQ ID NO: 44635 - protein, 77 aa, Homo sapiens
MDDDIHQLEDPSVFPAVIVEQVPYPDLLHLYSGLELDDVHNGIITDGTLCMTQDQILEGSFLLTDDNEATSHTMSTA

SEQ ID NO: 44636 - protein, 255 aa, Homo sapiens
MLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 44637 - protein, 265 aa, Homo sapiens
MPSLPHSHRVMLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 44638 - protein, 160 aa, Homo sapiens
MLDSVTHSTFLPNASFCDPLMSWTDLFSNEEYYPAFEHQTDADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 44639 - protein, 575 aa, Homo sapiens
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 44640 - protein, 264 aa, Homo sapiens
MVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGTGLWLTWLLKAFWGKKRIETIPFL

SEQ ID NO: 44641 - protein, 596 aa, Homo sapiens
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTAPSYLENATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQAMSGLVVPPM

SEQ ID NO: 44642 - protein, 551 aa, Homo sapiens
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGMKQKSAFAPVVRPQASPPPSCTSANGNGLQAMSGLVVPPM

SEQ ID NO: 44643 - protein, 191 aa, Homo sapiens
  MOD_RES (1)..(1): Any amino acid
XFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQGSLLGAEDVAAEKTNWPFCEVGGIFHFDELMLKKGTGKLCLGW

SEQ ID NO: 44644 - protein, 602 aa, Homo sapiens
MFPAQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 44645 - protein, 598 aa, Homo sapiens
MDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 44646 - protein, 184 aa, Homo sapiens
RGSVQHPPVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 44647 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 44648 - protein, 200 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGFPSPSVATTYSSVPPAFPAQVSSFPSSAVTNSFSASTGLSDMTATFSPRTIEIC

SEQ ID NO: 44649 - protein, 232 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPETAMSKFFTSIQRT

SEQ ID NO: 44650 - protein, 476 aa, Homo sapiens
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 44651 - protein, 426 aa, Homo sapiens
MNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 44652 - protein, 261 aa, Homo sapiens
MRVGLPSEASSCPWSARGPRDPPERRRSGLAHVLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPVEAARDPGCLVAAQQQQQPPPPPPITHTTCHCGPF

SEQ ID NO: 44653 - protein, 476 aa, Homo sapiens; identical to SEQ ID NO: 44650

SEQ ID NO: 44654 - protein, 486 aa, Homo sapiens
MLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 44655 - protein, 589 aa, Homo sapiens
MAVARGVGSPEPAPPQLYKWGGCGLGEPGSALERRGAAARGRCGRARAPRLPDSFPRGECPKPGARAPRSVRCGEPLPPASPPPARPQAQRARPRAPHSRRRAMLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 44656 - protein, 306 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 44657 - protein, 361 aa, Homo sapiens
MYPEALPVGILSNPDTFKRRSGSYSNDKPEVWFAAGSGSPNQKLSSSCVGRACGEMDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 44658 - protein, 815 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 44659 - protein, 834 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKRLNRSVSLLNACKLNRSTPSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 44660 - protein, 834 aa, Homo sapiens; identical to SEQ ID NO: 44659

SEQ ID NO: 44661 - protein, 981 aa, Homo sapiens
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 44662 - protein, 245 aa, Homo sapiens [sequence omitted]

SEQ ID NO: 44663 - protein, 923 aa, Homo sapiens
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 44664 - protein, 259 aa, Homo sapiens
MLLRSWFGNKDFQALPILARLPSMPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 44665 - protein, 236 aa, Homo sapiens
MPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 44666 - protein, 236 aa, Homo sapiens; identical to SEQ ID NO: 44665

SEQ ID NO: 44667 - protein, 232 aa, Homo sapiens
MEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 44668 - protein, 448 aa, Homo sapiens
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 44669 - protein, 463 aa, Homo sapiens
MLFRYAEKITRKYSEMDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 44670 - protein, 307 aa, Homo sapiens
MNQAELMQLDMEGMLQHFQKVIPHQFDGVPDKLIQAAYQVKYNSKKMKKLEKEYTTIKTKEMEEQVEIKRLRTENRLLKQRIETLEKESASLADRLIQGQVTRAQEAEENYLIKRELATIKQQSDEASAKLEQAENTIRKLQHQQQWHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQSGTCGPLLKIIFFNA

SEQ ID NO: 44671 - protein, 810 aa, Homo sapiens
MVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPIATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 44672 - protein, 810 aa, Homo sapiens; identical to SEQ ID NO: 44671

SEQ ID NO: 44673 - protein, 821 aa, Homo sapiens
MVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPIATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKESASLADRLIQHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 44674 - protein, 296 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGSGRDAGGVEPLLPDAAGPGVCEEWLGQLRV

SEQ ID NO: 44675 - protein, 431 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 44676 - protein, 217 aa, Homo sapiens
MSWVQATLLARGLCRAWGGTCGAALTGTSISQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 44677 - protein, 296 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVELTCCPRRRGKWKRRRRSGTSTTRCSWTWSM

SEQ ID NO: 44678 - protein, 589 aa, Homo sapiens
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 44679 - protein, 50 aa, Homo sapiens
MSVSVHENRKSRASSGSINIYLFHKSSYADSVLTHLNLLRQQRLFTDVLL

SEQ ID NO: 44680 - protein, 4 aa, Homo sapiens
MSVS

SEQ ID NO: 44681 - protein, 589 aa, Homo sapiens; identical to SEQ ID NO: 44678

SEQ ID NO: 44682 - protein, 516 aa, Homo sapiens
MFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 44683 - protein, 643 aa, Homo sapiens
MVDAGGVENITQLPQELPQMMAAAADGLGSIAIDTTQLNMSVTDPTAWATAMNNLGMVPVGLPGQQLVSDSICVPGFDPSLNMMTGITPINPMIPGLGLVPPPPPTEVAVVKEIIHCKSCTLFPQNPNLPPPSTRERPPGCKTVFVGGLPENATEEIIQEVFEQCGDITAIRKSKKNFCHIRFAEEFMVDKAIYLSGYRMRLGSSTDKKDSGRLHVDFAQARDDFYEWECKQRMRAREERHRRKLEEDRLRPPSPPAIMHYSEHEAALLAEKLKDDSKFSEAITVLLSWIERGEVNRRSANQFYSMVQSANSHVRRLMNEKATHEQEMEEAKENFKNALTGILTQFEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQLKGTKELVETNGHSHEDSNEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 44684 - protein, 643 aa, Homo sapiens; identical to SEQ ID NO: 44683

SEQ ID NO: 44685 - protein, 235 aa, Homo sapiens
MVDKAIYLSGYRMRLGSSTDKKDSGRLHVDFAQARDDFYEWECKQRMRAREERHRRKLEEDRLRPPSPPAIMHYSEHEAALLAEKLKDDSKFSEAITVLLSWIERGEVNRRSANQFYSMVQSANSHVRRLMNEKATHEQEMEEAKENFKNALTGILTQFEQIVAVFNASTRQKAWDHFSKAQRKNIDIWRKHSEELRNAQSEQLMGIRREEEMEMSDDENCDSPTKKMRVDESGA

SEQ ID NO: 44686 - protein, 610 aa, Homo sapiens
MQRDFRWLWVYEIGYAADNSRTLNVDSTAMTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 44687 - protein, 638 aa, Homo sapiens
LPFDPANNNEPLQFGSASGPLVTEGLIENGGESSKKRKRTNTPSADNSRTLNVDSTAMTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 44688 - protein, 610 aa, Homo sapiens; identical to SEQ ID NO: 44686

SEQ ID NO: 44689 - protein, 581 aa, Homo sapiens
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 44690 - protein, 581 aa, Homo sapiens; identical to SEQ ID NO: 44689

SEQ ID NO: 44691 - protein, 376 aa, Homo sapiens
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEES

SEQ ID NO: 44692 - protein, 468 aa, Homo sapiens
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMKK

SEQ ID NO: 44693 - protein, 372 aa, Homo sapiens
MESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 44694 - protein, 510 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 44695 - protein, 306 aa, Homo sapiens
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQASITQSRPAPFTSAPPAPTSCCFLFQIQ

SEQ ID NO: 44696 - protein, 522 aa, Homo sapiens
MGREELFLTFSFSSGFQESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 44697 - protein, 517 aa, Homo sapiens
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 44698 - protein, 372 aa, Homo sapiens; identical to SEQ ID NO: 44693

SEQ ID NO: 44699 - protein, 402 aa, Homo sapiens
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 44700 - protein, 472 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 44701 - protein, 495 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 44702 - protein, 529 aa, Homo sapiens
MFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 44703 - protein, 529 aa, Homo sapiens; identical to SEQ ID NO: 44702

SEQ ID NO: 44704 - protein, 428 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 44705 - protein, 467 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 44706 - protein, 483 aa, Homo sapiens
MKKGIRYETSRKTSYIFQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 44707 - protein, 367 aa, Homo sapiens
MFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 44708 - protein, 484 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 44709 - protein, 295 aa, Homo sapiens
  MOD_RES (1)..(1): Any amino acid
XVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 44710 - protein, 226 aa, Homo sapiens
MPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSY

SEQ ID NO: 44711 - protein, 195 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQIA

SEQ ID NO: 44712 - protein, 300 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKA

SEQ ID NO: 44713 - protein, 150 aa, Homo sapiens
  MOD_RES (1)..(1): Any amino acid
XPGRGSPKDRLPPAPRKRALVSVGVAERAVHETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSY

SEQ ID NO: 44714 - protein, 437 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 44715 - protein, 314 aa, Homo sapiens
  MOD_RES (1)..(1): Any amino acid
XNRGVVSRGWRPGWRRPGRGSPKDRLPPAPRKRALVSVGVAERAVHETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVG

SEQ ID NO: 44716 - protein, 188 aa, Homo sapiens
MKKGIRYETSRKTSYIFQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLP

SEQ ID NO: 44717 - protein, 296 aa, Homo sapiens
MPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQP

SEQ ID NO: 44718 - protein, 311 aa, Homo sapiens
  MOD_RES (1)..(1): Any amino acid
XGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLK

SEQ ID NO: 44719 - protein, 313 aa, Homo sapiens
NRGVVSRGWRPGWRRPGRGSPKDRLPPAPRKRALVSVGVAERAVHETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVG

SEQ ID NO: 44720 - protein, 925 aa, Homo sapiens
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 44721 - protein, 863 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 44722 - protein, 915 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEESSYGSPFTPAKRPKRKVAPKRRQERPVAPPKKRRRKIHRMDHYAAETRQDKMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 44723 - protein, 888 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 44724 - protein, 875 aa, Homo sapiens [sequence omitted]

SEQ ID NO: 44725 - protein, 663 aa, Homo sapiens
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLPAIEHQIANMML

SEQ ID NO: 44726 - protein, 875 aa, Homo sapiens [sequence omitted]

SEQ ID NO: 44727 - protein, 254 aa, Homo sapiens
MSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPVCSILHVATEVTSISQCDRRTLFSLSGASSMSPI

SEQ ID NO: 44728 - protein, 257 aa, Homo sapiens
MSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNG

SEQ ID NO: 44729 - protein, 399 aa, Homo sapiens
MASPGKPGADEAQEEEGELEGGSAGPRAAILEQAEELFLLCDKEAKGFITKHDLQGLQSDLPLTPEQLEAVFESLDRAHTGFLTAREFCLGLGMFVGVASAQGANPCRTPEETFESGGLDVQGTAGSLDEEEEEEERFHTVLEQLGVAPVLGKQRAVRTLWARLQRERPELLGSFEDVLIRASACLEEAARERDGLEQALRRRESEHEREVRALYEETEQLREQSRRPPSQNFARGERRSRLELELQSREQDLERAGLRQRELEQQLHAQAAEHLEAQAQNSQLWRAHEALRTQLEGAQEQIRRLESEARGRQEQTQRDVVAVSRNMQKEKVSLLRQLELLRELNTRLRDDRDACEARRAGSSCRKALTTARLPGPTCCCCCCWARPPRRGSGHLPSAR

SEQ ID NO: 44730 - protein, 294 aa, Homo sapiens
MASPGKPGADEAQEEEGELEGGSAGPRAAILEQAEELFLLCDKEAKGFITKHDLQGLQSDLPLTPEQLEAVFESLDRAHTGFLTAREFCLGLGMFVGVASAQGANPCRTPEETFESGGLDVQGTAGSLDEEEEEEERFHTVLEQLGVAPVLGKQRAVRTLWARLQRERPELLGSFEDVLIRASACLEEAARERDGLEQALRRRESEHEREVRALYEETEQLREQSRRPPSQNFARGERRSRLELELQSREQDLERAGLRQRERRGRRLQEHAERESQPATATGAAQGAEYTAAG

SEQ ID NO: 44731 - protein, 88 aa, Homo sapiens
MASPGKPGADEAQEEEGELEGGSAGPRAAILEQAEELFLLCDKEAKGFITKHDLQGLQSDLPLTPEQLEAVFESLDRAHTGFLTAREF

SEQ ID NO: 44732 - protein, 34 aa, Homo sapiens
MASPGKPGADEAQEEEGELEGGSAGPRAAILEQA

SEQ ID NO: 44733 - protein, 294 aa, Homo sapiens; identical to SEQ ID NO: 44730

SEQ ID NO: 44734 - protein, 53 aa, Homo sapiens
MASPGKPGADEAQEEEGELEGGSAGPRAAILEQAEELFLLCDKEAKGFITKHD

SEQ ID NO: 44735 - protein, 81 aa, Homo sapiens
MASPGKPGADEAQEEEGELEGGSAGPRAAILEQAEELFLLCDKEAKGFITKHDLQGLQSDLPLTPEQLEAVFESLDRAHTG

SEQ ID NO: 44736 - protein, 395 aa, Homo sapiens
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRCVGGHWPVLRAPPRSLGSEGPV

SEQ ID NO: 44737 - protein, 731 aa, Homo sapiens
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRERNKHLRDERDICFQKNKAAKANTAASRASWKKRSGSVIGKYVDSRGILRSQSEEEEEVFGIPRRSSLGLSGYPLTEEEPGTGEPGPGGPYPRPLRRIISVEEDPLPQLLDGGFEQPLSKCSEEEEVSDQGVQGQIPEAPPLKLTPTSPRGQPVGKEALCKEESSPSAPDRLFKIVFVGNSAVGKTSFLRRFCEDRFSPGMAATVGIDYRVKTLNVDNSQVALQLWDTAGQERYRCITQQFFRKADGVIVMYDLTDKQSFLSVRRWLSSVEEAVGDRVPVLLLGNKLDNEKEREVPRGLGEQLATENNLIFYECSAYSGHNTKESLLHLARFLKEQEDTVREDTIQVGHPAKKKSCCG

SEQ ID NO: 44738 - protein, 462 aa, Homo sapiens
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRERNKHLRDERDICFQKNKAAKANTAASRASWKKRSGSVIGKYVDSRGILRRWPQRDRGIPTLQYQTQRDLEDCKHEMKKICKAEVTLEM

SEQ ID NO: 44739 - protein, 118 aa, Homo sapiens
  MOD_RES (1)..(1): Any amino acid
XEKEMEVYRVTESLQREKAGLLKQLDFLRERNKHLRDERDICFQKNKAAKANTAASRASWKKRSGSVIGKYVDSRGILRRWPQRDRGIPTLQYQTQRDLEDCKHEMKKICKAEVTLEM

SEQ ID NO: 44740 - protein, 640 aa, Homo sapiens
MVSNPVHGLPFLPGTSFKDSTKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKELIRMCSHGEGKINYYNFVRAFSN

SEQ ID NO: 44741 - protein, 550 aa, Homo sapiens
MSWPVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKEVTCKRLLLPAFTFPSPVWIPLCGL

SEQ ID NO: 44742 - protein, 621 aa, Homo sapiens
MLKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKELIRMCSHGEGKINYYNFVRAFSN

SEQ ID NO: 44743 - protein, 749 aa, Homo sapiens
MALPLLPGNSFNRNVGKEKFHKSQHWGFCNNVMMLVSDEKPGIGGEPLLGQKIKPKCSIYPKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 44744 - protein, 162 aa, Homo sapiens
MSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 44745 - protein, 250 aa, Homo sapiens
MKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILFFCKTSHRQMC

SEQ ID NO: 44746 - protein, 777 aa, Homo sapiens
GGQTTRPGGAAACRALSSGTLDFRTLSAMALPLLPGNSFNRNVGKEKFHKSQHWGFCNNVMMLVSDEKPGIGGEPLLGQKIKPKCSIYPKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 44747 - protein, 730 aa, Homo sapiens
  MOD_RES (1)..(1): Any amino acid
XNNTAGRRRCLPGPLFWDPGFSDTERHGPASAAGQQLQPQREKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 44748 - protein, 239 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 44749 - protein, 143 aa, Homo sapiens
MGELQYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 44750 - protein, 127 aa, Homo sapiens
MELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 44751 - protein, 127 aa, Homo sapiens; identical to SEQ ID NO: 44750

SEQ ID NO: 44752 - protein, 142 aa, Homo sapiens
MFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 44753 - protein, 821 aa, Homo sapiens
MPTRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 44754 - protein, 821 aa, Homo sapiens
MKSRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 44755 - protein, 777 aa, Homo sapiens
MPKGVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCHKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 44756 - protein, 200 aa, Homo sapiens
MLARLLKFEEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 44757 - protein, 785 aa, Homo sapiens
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 44758 - protein, 493 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 44759 - protein, 493 aa, Homo sapiens; identical to SEQ ID NO: 44758

SEQ ID NO: 44760 - protein, 493 aa, Homo sapiens; identical to SEQ ID NO: 44758

SEQ ID NO: 44761 - protein, 349 aa, Homo sapiens
MEDTSAFRKQPRLLSIMNSLSSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 44762 - protein, 52 aa, Homo sapiens
MLKALFLTMLTLALVKSQDTEETITYTQCTDGYEWDPVRQQCKDIDECDIVP

SEQ ID NO: 44763 - protein, 27 aa, Homo sapiens
MLKALFLTMLTLALVKSQDTEETITYT

SEQ ID NO: 44764 - protein, 355 aa, Homo sapiens
MKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 44765 - protein, 87 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQE

SEQ ID NO: 44766 - protein, 172 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQ

SEQ ID NO: 44767 - protein, 119 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFV

SEQ ID NO: 44768 - protein, 106 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASS

SEQ ID NO: 44769 - protein, 62 aa, Homo sapiens
MLKALFLTMLTLALVKSQDTEETITYTQCTDGYEWDPVRQQCKDIDECDIVPDACKGGMKCV

SEQ ID NO: 44770 - protein, 443 aa, Homo sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 44771 - protein, 202 aa, Homo sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCV

SEQ ID NO: 44772 - protein, 183 aa, Homo sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGS

SEQ ID NO: 44773 - protein, 443 aa, Homo sapiens; identical to SEQ ID NO: 44770

SEQ ID NO: 44774 - protein, 821 aa, Homo sapiens
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 44775 - protein, 886 aa, Homo sapiens
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 44776 - protein, 867 aa, Homo sapiens
MRGFNLLLFWGCCVMHSWEGHIRPTRKPNTKGNNCRDSTLCPAYATCTNTVDSYYCACKQGFLSSNGQNHFKDPGVRCKDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVVSKYYNSLAKCVLKEEQGDLRDLEFPGTCAAERINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 44777 - protein, 745 aa, Homo sapiens
MRGFNLLLFWGCCVMHSWEGHIRPTRKPNTKGNNCRDSTLCPAYATCTNTVDSYYCACKQGFLSSNGQNHFKDPGVRCKDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 44778 - protein, 709 aa, Homo sapiens
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 44779 - protein, 821 aa, Homo sapiens; identical to SEQ ID NO: 44774

SEQ ID NO: 44780 - protein, 553 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 44781 - protein, 554 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 44782 - protein, 273 aa, Homo sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 44783 - protein, 273 aa, Homo sapiens; identical to SEQ ID NO: 44782

SEQ ID NO: 44784 - protein, 273 aa, Homo sapiens; identical to SEQ ID NO: 44782

SEQ ID NO: 44785 - protein, 273 aa, Homo sapiens; identical to SEQ ID NO: 44782

SEQ ID NO: 44786 - protein, 293 aa, Homo sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 44787 - protein, 293 aa, Homo sapiens; identical to SEQ ID NO: 44786

SEQ ID NO: 44788 - protein, 293 aa, Homo sapiens [sequence omitted]

SEQ ID NO: 44789 - protein, 258 aa, Homo sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGA

SEQ ID NO: 44790 - protein, 293 aa, Homo sapiens; identical to SEQ ID NO: 44786

SEQ ID NO: 44791 - protein, 293 aa, Homo sapiens; identical to SEQ ID NO: 44786

SEQ ID NO: 44792 - protein, 293 aa, Homo sapiens; identical to SEQ ID NO: 44786

SEQ ID NO: 44793 - protein, 258 aa, Homo sapiens; identical to SEQ ID NO: 44789

SEQ ID NO: 44794 - protein, 258 aa, Homo sapiens; identical to SEQ ID NO: 44789

SEQ ID NO: 44795 - protein, 258 aa, Homo sapiens
MGSRAELCTLLGGFSFLLLLIPGEGAKGGSLRESQGVCSKQTLVVPLHYNESYSQPVYKPYLTLCAGRRICSTYRTMYRVMWREVKREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGA

SEQ ID NO: 44796 - protein, 293 aa, Homo sapiens; identical to SEQ ID NO: 44786

SEQ ID NO: 44797 - protein, 293 aa, Homo sapiens; identical to SEQ ID NO: 44786

SEQ ID NO: 44798 - protein, 293 aa, Homo sapiens; identical to SEQ ID NO: 44786

SEQ ID NO: 44799 - protein, 293 aa, Homo sapiens [sequence omitted]

SEQ ID NO: 44800 - protein, 293 aa, Homo sapiens; identical to SEQ ID NO: 44786

SEQ ID NO: 44801 - protein, 293 aa, Homo sapiens; identical to SEQ ID NO: 44786

SEQ ID NO: 44802 - protein, 293 aa, Homo sapiens; identical to SEQ ID NO: 44786

SEQ ID NO: 44803 - protein, 258 aa, Homo sapiens; identical to SEQ ID NO: 44789

SEQ ID NO: 44804 - protein, 293 aa, Homo sapiens; identical to SEQ ID NO: 44786

SEQ ID NO: 44805 - protein, 426 aa, Homo sapiens
MANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 44806 - protein, 71 aa, Homo sapiens
MNKHGICVVDDFLGKETGQQIGDEVRALHDTGKFTDGSWSARRVTRPRTSEAIRSPGSRARSPAAKPLGCS

SEQ ID NO: 44807 - protein, 407 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 44808 - protein, 407 aa, Homo sapiens; identical to SEQ ID NO: 44807

SEQ ID NO: 44809 - protein, 239 aa, Homo sapiens
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 44810 - protein, 239 aa, Homo sapiens; identical to SEQ ID NO: 44809

SEQ ID NO: 44811 - protein, 534 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 44812 - protein, 534 aa, Homo sapiens; identical to SEQ ID NO: 44811

SEQ ID NO: 44813 - protein, 145 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPV

SEQ ID NO: 44814 - protein, 431 aa, Homo sapiens
MEQPGTAASPVSGSMFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDDEEFALANHLIKVKLEGHELPADLPPHLVPPSKRRHE

SEQ ID NO: 44815 - protein, 148 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDS

SEQ ID NO: 44816 - protein, 510 aa, Homo sapiens
MFSWVSKDARRKKEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 44817 - protein, 543 aa, Homo sapiens
MFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 44818 - protein, 171 aa, Homo sapiens
MPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDQGQVQIRRDLLQPGACRRQAERLQGQDLDGGDQAPQLSAGAHLEAQRCGPRRHAG

SEQ ID NO: 44819 - protein, 407 aa, Homo sapiens
MCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 44820 - protein, 413 aa, Homo sapiens
MFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESSPVAEMTSR

SEQ ID NO: 44821 - protein, 533 aa, Homo sapiens
MFSWLKRGGARGQQPEAIRTVTSALKELYRTKLLPLEEHYRFGAFHSPALEDADFDGKPMVLVAGQYSTGKTSFIQYLLEQEVPGSRVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 44822 - protein, 226 aa, Homo sapiens
MPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 44823 - protein, 535 aa, Homo sapiens
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 44824 - protein, 175 aa, Homo sapiens
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGPAAGPGL

SEQ ID NO: 44825 - protein, 541 aa, Homo sapiens
MFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 44826 - protein, 363 aa, Homo sapiens
MSMDVTFLGTGAAYPSPTRGASAVVLRCEGECWLFDCGEGTQTQLMKSQLKAGRITKIFITHLHGDHFFGLPGLLCTISLQSGSMVSKQPIEIYGPVGLRDFIWRTMELSHTELVFHYVVHELVPTADQCPAEELKEFAHVNRADSPPKEEQGRTILLDSEENSYLLFDDEQFVVKAFRLFHRIPSFGFSVVEKKRPGKLNAQKLKDLGVPPGPAYGKLKNGISVVLENGVTISPQDVLKKPIVGRKICILGDCSGVVGDGGVKLCFEADLLIHEATLDDAQMDKAKEHGHSTPQMAATFAKLCRAKRLVLTHFSQRYKPVALAREGETDGIAELKKQAESVLDLQEVTLAEDFMVISIPIKK

SEQ ID NO: 44827 - protein, 826 aa, Homo sapiens
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 44828 - protein, 807 aa, Homo sapiens
MWALCSLLRSAAGRTMSQGRTISQAPARRERPRKDPLRHLRTREKRGPSGCSGGPNTVYLQVVAAGSRDSGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 44829 - protein, 786 aa, Homo sapiens
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 44830 - protein, 286 aa, Homo sapiens
  MOD_RES (1)..(1): Any amino acid
XPHGVSQRRGVRDSSLVVAFICKLHLKRGNFLVLKAKEMGLPVGTAAIAPIIAAVKDGKSITHEGREVLQILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNI

SEQ ID NO: 44831 - protein, 278 aa, Homo sapiens
ILAEELCTPPDPGAAFVVVECPDESFIQPICENATFQRFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLH

SEQ ID NO: 44832 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 44833 - protein, 267 aa, Homo sapiens; identical to SEQ ID NO: 44832

SEQ ID NO: 44834 - protein, 1016 aa, Homo sapiens [sequence omitted]

SEQ ID NO: 44835 - protein, 347 aa, Homo sapiens
MADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGEGTKGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 44836 - protein, 353 aa, Homo sapiens
MGSGGRSAQVSTGQRAWLLPCRFLKNTMSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 44837 - protein, 326 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 44838 - protein, 346 aa, Homo sapiens
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 44839 - protein, 387 aa, Homo sapiens
MAVRLCDVASLLRSGSWAAEPWTGVIAAMETQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 44840 - protein, 346 aa, Homo sapiens; identical to SEQ ID NO: 44838

SEQ ID NO: 44841 - protein, 359 aa, Homo sapiens
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 44842 - protein, 359 aa, Homo sapiens; identical to SEQ ID NO: 44841

SEQ ID NO: 44843 - protein, 90 aa, Homo sapiens
MTQKELEQLFSQYGRIITSRILVDQVTGISRGVGFIRFDKRIEAEEAIKGLNGQKPPGATEPITVKFANNPSQKTNQAILSQLYQSPNRR

SEQ ID NO: 44844 - protein, 189 aa, Homo sapiens
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQ

SEQ ID NO: 44845 - protein, 359 aa, Homo sapiens; identical to SEQ ID NO: 44841

SEQ ID NO: 44846 - protein, 367 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 44847 - protein, 360 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKRFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 44848 - protein, 383 aa, Homo sapiens
MRLLLLREIVINESRNCSFMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44849 - protein, 371 aa, Homo sapiens
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44850 - protein, 385 aa, Homo sapiens
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44851 - protein, 380 aa, Homo sapiens
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44852 - protein, 366 aa, Homo sapiens
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44853 - protein, 366 aa, Homo sapiens
MEQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44854 - protein, 369 aa, Homo sapiens
MRLKNQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 44855 - protein, 284 aa, Homo sapiens
MFRAAAPGQLRRAVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 44856 - protein, 333 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 44857 - protein, 255 aa, Homo sapiens
MAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 44858 - protein, 346 aa, Homo sapiens
MYLSLWVTINTVNLRNTLSGLRGAVTTVGMIKSDVPGTQEWLDERRRQGDLPLPTNSNPVLSLELCDPGQGPAPFQAVVVLIQPGRGLALRPPPSCLFPPDPTPSPPAGQIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 44859 - protein, 570 aa, Homo sapiens
MLVPLAKLSCLGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 44860 - protein, 617 aa, Homo sapiens
MLVPLAKLSCLAYQCFHALKIKKNYLPLCATRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 44861 - protein, 428 aa, Homo sapiens
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLGGPGPERTPGSGSGSGLQAPGPALTPSLLPTHTLTPVLLTPSSLPPSIHFWSTLSPIAPRSPAKLSFQFPSSGSAQVHIPSISVDGLSTPVVLSPGPQKP

SEQ ID NO: 44862 - protein, 407 aa, Homo sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKAIKTEKLEEPPEDSPPVEEVRTVIRFVTNKTDKHVTRPVVSLPSTSEAAAASAFLASSVSAKISSLMLPNAASISSASPFSSRSPSLSPNSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQFPTLLNGHMPVPIPSLDRAASPVLLSSNSQKS

SEQ ID NO: 44863 - protein, 38 aa, Homo sapiens
MESAITLWQFLLQLLLDQKHEHLICWTSNDGEFKLLKA

SEQ ID NO: 44864 - protein, 160 aa, Homo sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKA

SEQ ID NO: 44865 - protein, 405 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQVACSLFMVSPLLSFICPFKQIQNLYTQVCFLLLRFVLERLCVTVM

SEQ ID NO: 44866 - protein, 431 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 44867 - protein, 521 aa, Homo sapiens
RPQDPRRRCRVRGRGGRGARSRGGGRCGRLRAPGGLGLAAAAFYGSAAGVAAAAAPSSSFQREEEAEGGEAHRVRGGDRGGAPRAASLIAMDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 44868 - protein, 268 aa, Homo sapiens
MNGTANPLLDREEHCLRLGESFEKRPRASFHTIRYDFKPASIDTSCEGELQVGKGDEVTITLPHIPGSTPPMTVFKGNKRPYQKDCVLIINHDTGEYVLEKLSSSIQVKKTRAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 44869 - protein, 167 aa, Homo sapiens
MKSQLHCHISLAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 44870 - protein, 992 aa, Homo sapiens
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 44871 - protein, 992 aa, Homo sapiens; identical to SEQ ID NO: 44870

SEQ ID NO: 44872 - protein, 1228 aa, Homo sapiens
MIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 44873 - protein, 1308 aa, Homo sapiens
MDPSGSRGRPTWVLAGGLLAVALALGGRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 44874 - protein, 1246 aa, Homo sapiens
MDPSGSRGRPTWVLAGGLLAVALALGGRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQRSGNQESFWQYLVGTPEIGLIEWMSEK

SEQ ID NO: 44875 - protein, 293 aa, Homo sapiens
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFRGMGILGLINLVYFSENYTSEAHQILSRSNHPKLGYSYAIVGINLTEMAYSLLKSEALKFHLYNLVPGIPTMEHFHQFYCYLVYEFDKFWFEEEPESIMYFNLYREKFHEKIKGLLLDCNVALTLKV

SEQ ID NO: 44876 - protein, 168 aa, Homo sapiens
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFRG

SEQ ID NO: 44877 - protein, 35 aa, Homo sapiens
MFISLWEFFYGHFFRFWMKWLLRQMTGKCELQRIF

SEQ ID NO: 44878 - protein, 621 aa, Homo sapiens
MAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 44879 - protein, 29 aa, Homo sapiens
IHRLVVAFQDSVSLRPSIRFQGSQGEMSL

SEQ ID NO: 44880 - protein, 397 aa, Homo sapiens
MEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 44881 - protein, 962 aa, Homo sapiens
MDTDLYDEFGNYIGPELDSDEDDDELGRETKDLDEMDDDDDDDDVGDHDDDHPGMEVVLHEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 44882 - protein, 937 aa, Homo sapiens
MDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 44883 - protein, 972 aa, Homo sapiens
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 44884 - protein, 640 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVANLNSKDLSYTLKDYVFKELQRDWPGYSEIDRRSLESVLSRKLNPSQNAAGTSRSESPVCSSRDAVSSPQKRLLDSEFIDPLMNKKARISHLTNRVPPTLNGHLNPTSEKSAAGLPLPPAAAAIPTPPPLPSTYLPISHPPQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 44885 - protein, 390 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 44886 - protein, 547 aa, Homo sapiens
MRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 44887 - protein, 455 aa, Homo sapiens
MCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 44888 - protein, 113 aa, Homo sapiens
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSY

SEQ ID NO: 44889 - protein, 533 aa, Homo sapiens
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 44890 - protein, 191 aa, Homo sapiens
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAV

SEQ ID NO: 44891 - protein, 428 aa, Homo sapiens
MSTHQFYRKYMCPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 44892 - protein, 418 aa, Homo sapiens
MCPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 44893 - protein, 424 aa, Homo sapiens
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIERLHLPPDLSDTVSRSSKMDLAESAKRLGPGCGMMAGGKKHLDF

SEQ ID NO: 44894 - protein, 476 aa, Homo sapiens
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEQIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEWVQDNYLRQERNIYPPGFSYLLKQKDSAWGEGSLQHSTFLMSFLAKATAFASRLVRHSEPLKQNGSGRIRQAAGPRLWHDGRRQEAPGLLGIPP

SEQ ID NO: 44895 - protein, 535 aa, Homo sapiens
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEAGVQWHDLGSRQPRLLGSSNSPASASLVAGITGAHHHTQLIFVFLVEMGFHHVGQAGLELLTSGDSSASASQSAGITGMSYRARPRALYFKENKSKVGARQLLETREEHLSSRLLILTQAERLCMGRRFFTAFHIFNELPCKGDCICLQTCQTQ

SEQ ID NO: 44896 - protein, 279 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 44897 - protein, 252 aa, Homo sapiens
MEAVVNLYQEVMKHADPRIQGYPLMGSPLLMTSILLTYVYFVLSLGPRIMANRKPFQLRGFMIVYNFSLVALSLYIVYEMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 44898 - protein, 296 aa, Homo sapiens
MEHLKAFDDEINAFLDNMFGPRDSRVRGWFMLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFIHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 44899 - protein, 270 aa, Homo sapiens
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 44900 - protein, 314 aa, Homo sapiens
MGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 44901 - protein, 299 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 44902 - protein, 88 aa, Homo sapiens
MEHFDASLSTYFKALLGPRGISSSVLRMGPPLHTVVGWLQQLQAAHSEEEEKMFHLCGFKHKEVVSQSSLPAVIPQNSLATIASHAPA

SEQ ID NO: 44903 - protein, 289 aa, Homo sapiens
MEHFDASLSTYFKALLGPRDTRVKGWFLLDNYIPTFICSVIYLLIVWLGPKYMRNKQPFSCRGILVVYKFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 44904 - protein, 326 aa, Homo sapiens
MEHFDASLSTYFKALLGPRDTRVKGWFLLDNYIPTFICSVIYLLIVWLGPKYMRNKQPFSCRGILVVYNLGLTLLSLYMFCESKREQPRRSACASRTDPSTQQQLPENRLVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 44905 - protein, 299 aa, Homo sapiens; identical to SEQ ID NO: 44901

SEQ ID NO: 44906 - protein, 265 aa, Homo sapiens
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVVNYLVFCWMQHDQCHSHFQNIFWSSLMYLSYLVLFCHFFFEAYIGKMRKTTKAE

SEQ ID NO: 44907 - protein, 265 aa, Homo sapiens; identical to SEQ ID NO: 44906

SEQ ID NO: 44908 - protein, 108 aa, Homo sapiens
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPV

SEQ ID NO: 44909 - protein, 137 aa, Homo sapiens
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQKL

SEQ ID NO: 44910 - protein, 281 aa, Homo sapiens
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 44911 - protein, 281 aa, Homo sapiens; identical to SEQ ID NO: 44910

SEQ ID NO: 44912 - protein, 165 aa, Homo sapiens
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFA

SEQ ID NO: 44913 - protein, 281 aa, Homo sapiens; identical to SEQ ID NO: 44910

SEQ ID NO: 44914 - protein, 165 aa, Homo sapiens; identical to SEQ ID NO: 44912

SEQ ID NO: 44915 - protein, 561 aa, Homo sapiens
MAIATSTQLARALYDNTAESPQELSFRRGDVLRVLQREGAGGLDGWCLCSLHGQQGIVPANRVKLLPAGPAPKPSLSPASPAQPGSPYPAPDHSNEDQEVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 44916 - protein, 468 aa, Homo sapiens
MAIATSVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 44917 - protein, 392 aa, Homo sapiens
MAIATSVYVVPPPARPCPTSGPPAGPCPPSPDLIYKIPRASGTQLAAPRDALEVYDVPPTALRVPSSGPYDCPASFSHPLTRVAPQPPGEDDAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 44918 - protein, 441 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 44919 - protein, 400 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAK

SEQ ID NO: 44920 - protein, 466 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSGRAILHSHQQCMRDPVSPNLRQHLSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 44921 - protein, 156 aa, Homo sapiens
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWKCYQ

SEQ ID NO: 44922 - protein, 219 aa, Homo sapiens
MDNYADLSDTELTTLLRRYNIPHGPVVDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 44923 - protein, 254 aa, Homo sapiens
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 44924 - protein, 146 aa, Homo sapiens
MTTNAGPLHPYWPQHLRLDNFVPNDRPTWHILAGLFSVTGVLVVTTWLLSGRAAVVPLGTWRRLSLCWFAVCGFIHLVIEGWFVLYYEDLLGDQAFLSQLWKEYAKGDSRYILGDNFTVCMETITACLWGPLSLWVVIAFLRQHPL

SEQ ID NO: 44925 - protein, 160 aa, Homo sapiens
MTTNAGPLHPYWPQHLRLDNFVPNDRPTWHILAGLFSVTGVLVVTTWLLSGRAAVVPLGTWRRLSLCWFAVCGFIHLVIEGWFVLYYEDLLGDQAFLSQLWKEYAKGDSRYILGDNFTVCMETITACLWGPLSLWVVIAFLRQHPLRFILQLVVSVGQIY

SEQ ID NO: 44926 - protein, 230 aa, Homo sapiens [sequence omitted]

SEQ ID NO: 44927 - protein, 290 aa, Homo sapiens
MCLAGCTPRKAAAPGRGALPRARLPRTAPAAATMFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 44928 - protein, 252 aa, Homo sapiens
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGNDTSPESFLLHNALARKPKRIRTAFSPSQLLRLEHAFEKNHYVVGAERKQLAHSLSLTETQVKVWFQNRRTKFKRQKLEEEGSDSQQKKKGTHHINRWRIATKQASPEEIDVTSDD

SEQ ID NO: 44929 - protein, 169 aa, Homo sapiens
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGKSMVSEPKNKVQKAEAGGRRLRFATKEKRDAPY

SEQ ID NO: 44930 - protein, 318 aa, Homo sapiens
MAIKSIASRLRGSRRFLSGFVAGAVVGAAGAGLAALQFFRSQGAEGALTGKQPDGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 44931 - protein, 368 aa, Homo sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 44932 - protein, 149 aa, Homo sapiens
MAPAGNNKFSSKAMAETFYLSNIVPQDFDNNSGYWNRIEMYCRELTERFEDVWVVSGPLTLPQTRGDGKKIVSYQVIGEDNVAVPSHLYKDHAGCCVESPLGTRTSEEATARIQERDDGGSDQRSGLVELGIYFEGRANRISGRIGCRV

SEQ ID NO: 44933 - protein, 272 aa, Homo sapiens
MGYFLKLYAYVNSHSLFVWVCDRSYKRSFRPMILNKIKELSRNQFSTMSHLRKDSQPSSPGDDAMDRSGLPDLQGRFELSGKNRQYPLDALEPQPSIGDIKDIKKAAKSMLDPAHKSHFHPVTPSLVFLCFIFDGLHQALLSVGVSKRSNTVVGNENEERGTPYASRFKDMPNFIALEKSSVLRHCCDLLIGIAAGSSDKICTSSLQVQRRFKAMMASIGRLSHGESADLLISCNAESAIGWISSRPWVGELMFTLLFGDFESPLHKLRKSS

SEQ ID NO: 44934 - protein, 297 aa, Homo sapiens
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 44935 - protein, 948 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 44936 - protein, 941 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 44937 - protein, 941 aa, Homo sapiens; identical to SEQ ID NO: 44936

SEQ ID NO: 44938 - protein, 129 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQE

SEQ ID NO: 44939 - protein, 915 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 44940 - protein, 960 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 44941 - protein, 350 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLGMFKFHIIVFIFAHKTCFDLFPLSLSM

SEQ ID NO: 44942 - protein, 694 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSP

SEQ ID NO: 44943 - protein, 483 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 44944 - protein, 429 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 44945 - protein, 457 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRCKESDSPHAVTVYMLEPHSCQYILGVESPVICKILDTADENGLLSLPN

SEQ ID NO: 44946 - protein, 904 aa, Homo sapiens
MEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 44947 - protein, 351 aa, Homo sapiens
MLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHD

SEQ ID NO: 44948 - protein, 904 aa, Homo sapiens; identical to SEQ ID NO: 44946

SEQ ID NO: 44949 - protein, 419 aa, Homo sapiens
MVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATACLPILQILDLPASTIMTKPYVLLCSSPQRVNTFSVVSWQWHPSHK

SEQ ID NO: 44950 - protein, 261 aa, Homo sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 44951 - protein, 53 aa, Homo sapiens
MAAAVPRAAFLSPLLPLLLGFLLLSAPHGGSGLHTKGALPLDTVTFYKIMVTS

SEQ ID NO: 44952 - protein, 974 aa, Homo sapiens
MRRAGIGEDSRLGLQAQPGAEPSPGRAGTERSLGGTQGPGQPCSCPGAMASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 44953 - protein, 874 aa, Homo sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLEQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 44954 - protein, 117 aa, Homo sapiens
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 44955 - protein, 137 aa, Homo sapiens
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGGQVE

SEQ ID NO: 44956 - protein, 140 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEQKYFDSGDYNMAKAKMKNKQLPSAGPDKNLVTGDHIPTPQDLPQRKSSLVTSKLAG

SEQ ID NO: 44957 - protein, 117 aa, Homo sapiens
MAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 44958 - protein, 133 aa, Homo sapiens
MAGGLGCDVCYWFVEDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGGQVE

SEQ ID NO: 44959 - protein, 105 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEVLLDPFLEVLLLNRSRGEFEI

SEQ ID NO: 44960 - protein, 144 aa, Homo sapiens
MSQKQEEENPAEETGEEKQDTQEKEGILPERAEEAKLKAKYPSLGQKPGGSDFLMKRLQKGVWGIVSYPLSLELKEVLRMKSVEQKYFDSGDYNMAKAKMKNKQLPSAGPDKNLVTGDHIPTPQDLPQRKSSLVTSKLAGGQVE

SEQ ID NO: 44961 - protein, 121 aa, Homo sapiens
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 44962 - protein, 133 aa, Homo sapiens
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAG

SEQ ID NO: 44963 - protein, 105 aa, Homo sapiens; identical to SEQ ID NO: 44959

SEQ ID NO: 44964 - protein, 113 aa, Homo sapiens
MAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 44965 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 44966 - protein, 141 aa, Homo sapiens
MISLPGPLVTNLLRFLFLGLSALDVIRGSLSLTNLSSSMAGVYVCKAHNEVGTAQCNVTLEVSTGPGAAVVAGAVVGTLVGLGLLAGLVLLYHRRGKALEEPANDIKVRSPLGLSFSAPKMEWLWKWRDAHFYRDSYLSKW

SEQ ID NO: 44967 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 44968 - protein, 259 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDD

SEQ ID NO: 44969 - protein, 178 aa, Homo sapiens
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 44970 - protein, 219 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVRGANRGLCQRRLKSRTNKASRL

SEQ ID NO: 44971 - protein, 238 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 44972 - protein, 192 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRLKSRTNKASRL

SEQ ID NO: 44973 - protein, 238 aa, Homo sapiens; identical to SEQ ID NO: 44971

SEQ ID NO: 44974 - protein, 224 aa, Homo sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRQVEVKDQQSKQALDLHHPKLMPGSGLALAPSTCPRCLFQEGAP

SEQ ID NO: 44975 - protein, 767 aa, Homo sapiens
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 44976 - protein, 758 aa, Homo sapiens
MPLQGLGLQRNPFLQGKRGPGLTSSPPLLPPSLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 44977 - protein, 770 aa, Homo sapiens
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 44978 - protein, 754 aa, Homo sapiens
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 44979 - protein, 738 aa, Homo sapiens
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRVWCSVRTPESSHEGLITDPHSPSRFRVIGSLSNSKEFSEHFRCPPGSPMNPPHKCEVW

SEQ ID NO: 44980 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 44981 - protein, 773 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 44982 - protein, 427 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 44983 - protein, 161 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKVQSSCLLESCSGNWDSFGNCH

SEQ ID NO: 44984 - protein, 318 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 44985 - protein, 187 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRKTEM

SEQ ID NO: 44986 - protein, 318 aa, Homo sapiens; identical to SEQ ID NO: 44984

SEQ ID NO: 44987 - protein, 392 aa, Homo sapiens
MEEQQPEPKSQRDSALGAAAAATPGGLSLSLSPGASGSSGSGSDGDSVPVSPQPAPPSPPAAPCLPPLAHHPHLPPHPPPPPPQHLAAPAHQPQPAAQLHRTTNFFIDNILRPDFGCKKEQPPPQLLVAAAARGGAGGGGRVERDRGQTAAGRDPVHPLGTRAPGAASLLCAPDANCGPPDGSQPAAAGAGASKAGNPAAAAAAAAAAVAAAAAAAAAKPSDTGGGGSGGGAGSPGAQGTKYPEHGNPAILLMGSANGGPVVKTDSQQPLVWPAWVYCTRYSDRPSSGPRTRKLKKKKNEKEDKRPRTAFTAEQLQRLKAEFQANRYITEQRRQTLAQELSLNESQIKIWFQNKRAKIKKATGIKNGLALHLMAQGLYNHSTTTVQDKDESE

SEQ ID NO: 44988 - protein, 333 aa, Homo sapiens
MEENDPKPGEAAAAVEGQRQPESSPGGGSGGGGGSSPGEADTGRRRALMLPAVLQAPGNHQHPHRITNFFIDNILRPEFGRRKDAGTCCAGAGGGRGGGAGGEGGASGAEGGGGAGGSEQLLGSGSREPRQNPPCAPGAGGPLPAAGSDSPGDGEGGSKTLSLHGGAKKGGDPGGPLDGSLKARGLGGGDLSVSSDSDSSQAGANLGAQPMLWPAWVYCTRYSDRPSSGPRSRKPKKKNPNKEDKRPRTAFTAEQLQRLKAEFQTNRYLTEQRRQSLAQELSLNESQIKIWFQNKRAKIKKATGNKNTLAVHLMAQGLYNHSTTAKEGKSDSE

SEQ ID NO: 44989 - protein, 727 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 44990 - protein, 429 aa, Homo sapiens
MSEHQKEQTLDTPSLRTVTLTVRVHGFILEVSKTKNPPIPDTFWPPRWDHRPSPGGETNAYCQMNHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 44991 - protein, 631 aa, Homo sapiens
MDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 44992 - protein, 247 aa, Homo sapiens
MQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 44993 - protein, 247 aa, Homo sapiens; identical to SEQ ID NO: 44992

SEQ ID NO: 44994 - protein, 727 aa, Homo sapiens; identical to SEQ ID NO: 44989

SEQ ID NO: 44995 - protein, 59 aa, Homo sapiens
MPPPADIVKVAIEWPGAYPKLMEIDQKKPLSAIIKEVCDGWSLANHEYFALQHADSSNF

SEQ ID NO: 44996 - protein, 727 aa, Homo sapiens; identical to SEQ ID NO: 44989

SEQ ID NO: 44997 - protein, 81 aa, Homo sapiens
MPPPADIVKVAIEWPGAYPKLMEIDQKKPLSAIIKEVCDGWSLANHEYFALQHADSSNFYITEKNRNEIKNGTILRLTTSP

SEQ ID NO: 44998 - protein, 149 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKP

SEQ ID NO: 44999 - protein, 720 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45000 - protein, 718 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45001 - protein, 632 aa, Homo sapiens
MERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45002 - protein, 720 aa, Homo sapiens; identical to SEQ ID NO: 44999

SEQ ID NO: 45003 - protein, 267 aa, Homo sapiens
EEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 45004 - protein, 732 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDKHLNPLDLPVTDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45005 - protein, 537 aa, Homo sapiens
MVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45006 - protein, 338 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGT

SEQ ID NO: 45007 - protein, 283 aa, Homo sapiens
YHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKNIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 45008 - protein, 452 aa, Homo sapiens [sequence omitted]

SEQ ID NO: 45009 - protein, 773 aa, Homo sapiens
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 45010 - protein, 836 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQNLASNQQKSGFRLNIQGLERTLQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 45011 - protein, 813 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 45012 - protein, 763 aa, Homo sapiens
MEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 45013 - protein, 807 aa, Homo sapiens
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKNCRGPSLIPQIKQEKRDGSTNNDPYVAFRRRTEKMQTRKNRKNDEASYEKMLKLRREFSRAITILEMIKRREKTKRELLHLTLEVVEKRYHLGDYGGEILNEVKISRSEKELYATPATLHNGNHHKVQECKTKHPHHLSLKEEASDVVRQKKKYPKKPKAEALITSQQPTPETLPVINKSDIKQYDFHSSDEDEFPQVLSPVSEPEEENDPDGPCAFRRRAGCQYYAPRLDQANHSCENSELADLDKLRYRHCLTTLTVPRRCIGFARRRIGRGGRVIMDRISTEHDPVLKQIDPEMLNSFSSSSQTIDFSSNFSRTNASSKHCENRLSLSEILSNIRSCRLQCFQPRLLNLQDSDSEECTSRKPGQTVNNKRVSAASVALLNTSKNGISVTGGITEEQFQTHQQQLVQMQRQQLAQLQQKQQSQHSSQQTHPKAQGSSTSDCMSKTLDSASAHFAASAVVSAPVPSRSEVAKEQNTGHNNINGVVQPSGTSKTLYSTNMALSSSPGISAVQLVRTVGHTTTNHLIPALCTSSPQTLPMNNSCLTNAVHLNNVSVVSPVNVHINTRTSAPSPTALKLATVAASMDRVPKVTPSSAISSIARENHEPERLGLNGIAETTVAMEVT

SEQ ID NO: 45014 - protein, 104 aa, Homo sapiens
MSHTILLVQPTKRPEGRTYADYESVNECMEGVCKMYEEHLKRMNPNSPSITYDISQLFDFIDDLADLSCLVYRADTQTYQPYNKDWIKEKIYVLLRRQAQQAGK

SEQ ID NO: 45015 - protein, 750 aa, Homo sapiens
YSKMEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 45016 - protein, 707 aa, Homo sapiens
MEIPNPPTSKCITYWKRKVKSEYMRLRQLKRLQANMGAKALYVANFAKVQEKTQILNEEWKKLRVQPVQSMKPVSGHPFLKKVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 45017 - protein, 747 aa, Homo sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 45018 - protein, 608 aa, Homo sapiens
MEEASCPTCSVNEACEWTPFSQKEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 45019 - protein, 751 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHRKCNYSFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 45020 - protein, 707 aa, Homo sapiens
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 45021 - protein, 746 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 45022 - protein, 225 aa, Homo sapiens
MYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPLLPRN

SEQ ID NO: 45023 - protein, 695 aa, Homo sapiens
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 45024 - protein, 695 aa, Homo sapiens; identical to SEQ ID NO: 45023

SEQ ID NO: 45025 - protein, 737 aa, Homo sapiens
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 45026 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 45027 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 45028 - protein, 434 aa, Homo sapiens; identical to SEQ ID NO: 45027

SEQ ID NO: 45029 - protein, 391 aa, Homo sapiens
MSIEKIWAREILDSRGNPTVEVDLYTAKGLFRAAVPSGASTGIYEALELRDGDKQRYLGKAKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 45030 - protein, 434 aa, Homo sapiens; identical to SEQ ID NO: 45027

SEQ ID NO: 45031 - protein, 391 aa, Homo sapiens; identical to SEQ ID NO: 45029

SEQ ID NO: 45032 - protein, 391 aa, Homo sapiens
MAMQKIFAREILDSRGNPTVEVDLHTAKGRFRAAVPSGASTGIYEALELRDGDKGRYLGKAKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 45033 - protein, 434 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 45034 - protein, 434 aa, Homo sapiens; identical to SEQ ID NO: 45033

SEQ ID NO: 45035 - protein, 283 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSF

SEQ ID NO: 45036 - protein, 154 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVIN

SEQ ID NO: 45037 - protein, 148 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVP

SEQ ID NO: 45038 - protein, 443 aa, Homo sapiens
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 45039 - protein, 213 aa, Homo sapiens
MRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 45040 - protein, 450 aa, Homo sapiens
MVSADAMVSADAMVSADAMVSADAMVSADAMVSADAMVSADAMVSADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 45041 - protein, 361 aa, Homo sapiens
MQKMESRGVELPSLWEKALKLIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 45042 - protein, 142 aa, Homo sapiens
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMG

SEQ ID NO: 45043 - protein, 328 aa, Homo sapiens
MAAGIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQRLPKVIGNQSLVNELAFTARKMMADEALGSGLVSRVFPDKEVMLDAALALAAEISSKSPVAVQSTKVNLLYSRDHSVAESLNYVASWNMSMLQTQDLVKSVQATTENKELKTVTFSKL

SEQ ID NO: 45044 - protein, 284 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGLQRRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 45045 - protein, 145 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPETSFNKCCAGSRLGIGWRSRIYYSM

SEQ ID NO: 45046 - protein, 146 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEETSFNKCCAGSRLGIGWRSRIYYSM

SEQ ID NO: 45047 - protein, 145 aa, Homo sapiens; identical to SEQ ID NO: 45045

SEQ ID NO: 45048 - protein, 213 aa, Homo sapiens
MNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYEVKKQRGKILLGLSRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQE

SEQ ID NO: 45049 - protein, 301 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 45050 - protein, 226 aa, Homo sapiens
MMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 45051 - protein, 301 aa, Homo sapiens; identical to SEQ ID NO: 45049

SEQ ID NO: 45052 - protein, 301 aa, Homo sapiens; identical to SEQ ID NO: 45049

SEQ ID NO: 45053 - protein, 135 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLT

SEQ ID NO: 45054 - protein, 307 aa, Homo sapiens
MALKQEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 45055 - protein, 151 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGW

SEQ ID NO: 45056 - protein, 125 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEANFL

SEQ ID NO: 45057 - protein, 70 aa, Homo sapiens
MMLQLLEKVIELENWTEGKGLIVRGAKNTFSSGSDLNAVKSLGTPETSFNKCCAGSRLGIGWRSRIYYSM

SEQ ID NO: 45058 - protein, 290 aa, Homo sapiens
MAALRVLLSCVRGPLRPPVRCPAWRPFASGANFEYIIAEKRGKNNTVGLIQLNRPKALNALCDGLIDELNQALKTFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 45059 - protein, 723 aa, Homo sapiens
MAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSKFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 45060 - protein, 627 aa, Homo sapiens
MAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSKFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 45061 - protein, 487 aa, Homo sapiens
MAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNYSVSKKKKKKKK

SEQ ID NO: 45062 - protein, 2033 aa, Homo sapiens
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTDPHAWVVQGPGGETKRAPAACFCIPAPDPDAVARASRLASELQALKQKLATVQSRLKASAVESLRPSQQAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 45063 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 45064 - protein, 705 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 45065 - protein, 570 aa, Homo sapiens [sequence omitted]

SEQ ID NO: 45066 - protein, 410 aa, Homo sapiens
MFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 45067 - protein, 715 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 45068 - protein, 187 aa, Homo sapiens
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 45069 - protein, 236 aa, Homo sapiens
MSKLPADSSVPQTGAANGDRDVPQAEVGRGRREPAPAQPEEAGEGAMAAARGGPVPAAREGRMAAARAAPAAAARGAPVAAAALARAAAAGRESPAAAAAREARMAEVARLLGEPVDEEGPEGRPRSRHGNGGLAALPYLRLRHPLSVLGINYQQFLRHYLENYPIAPGRIQELEERRRRFVEACRAREAAFDAEYQRNPHRVDLDILTFTIALTASEVINPLIEELGCDKFINRE

SEQ ID NO: 45070 - protein, 187 aa, Homo sapiens
MSKLPADSSVPQTGAANGDRDVPQAEVGRGRREPAPAQPEEAGESPAAAAAREARMAEVARLLGEPVDEEGPEGRPRSRHGNGGLAALPYLRLRHPLSVLGINYQQFLRHYLENYPIAPGRIQELEERRRRFVEACRAREAAFDAEYQRNPHRVDLDILTFTIALTASEVINPLIEELGCDKFINRE

SEQ ID NO: 45071 - protein, 333 aa, Homo sapiens
MKMDVSVRAAGCSDDLSSGEADVDPKLLELTADEEKCRSIRRQYRQLMYCVRQNREDIVSSANNSLTEALEEANVLFDGVSRTREAALDARFLVMASDLGKEKAKQLNSDMNFFNQLAFCDFLFLFVGLNWMEGDPDKLSDCDDSIALSFWKAIEKEATSWMVKAETFHFVFGSFKLERSAPKPRLEHQKKVRKMEENGNMPTKLQKLDLSSYPEATEKNVERILGLLQTYFRKYPDTPVSYFEFVIDPNSFSRTVENIFYVSFIVRDGFARIRLDEDRLPILEPMNVNQMGEGNDSSCHGRKQGVISLTLQEWKNIVAAFEISEAMITYSSY

SEQ ID NO: 45072 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 45073 - protein, 295 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEGIQLAGGRGVGV

SEQ ID NO: 45074 - protein, 543 aa, Homo sapiens
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQDNKNLSVIWCLFEWQLLDHCIAGVEGLLPPSSRTGVSRICV

SEQ ID NO: 45075 - protein, 1008 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQV

SEQ ID NO: 45076 - protein, 1014 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQVIIKTCL

SEQ ID NO: 45077 - protein, 155 aa, Homo sapiens
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLETSPH

SEQ ID NO: 45078 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 45079 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 45080 - protein, 539 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 45081 - protein, 1037 aa, Homo sapiens
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 45082 - protein, 1015 aa, Homo sapiens
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 45083 - protein, 1004 aa, Homo sapiens
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVSVAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLE

SEQ ID NO: 45084 - protein, 1005 aa, Homo sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 45085 - protein, 495 aa, Homo sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAGRRRNSVPQRPGPPASPASDPSRDQSSAGDVLWAFRQVPLWPCAPHQDPELEALHCL

SEQ ID NO: 45086 - protein, 495 aa, Homo sapiens; identical to SEQ ID NO: 45085

SEQ ID NO: 45087 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 45088 - protein, 545 aa, Homo sapiens
MHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 45089 - protein, 998 aa, Homo sapiens
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 45090 - protein, 1021 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 45091 - protein, 744 aa, Homo sapiens
MATEGAAQLGNRVAGMVSVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 45092 - protein, 1021 aa, Homo sapiens; identical to SEQ ID NO: 45090

SEQ ID NO: 45093 - protein, 213 aa, Homo sapiens
MAPAQRPLLPLLLLLLPLPPPPFARAEDAARANSDRYAVYWNRSNPRFHAGAGDDGGGYTVEVSINDYLDIYCPHYGAPLPPAERMEHYVLYMVNGEGHASCDHRQRGFKRWECNRPAAPGGPLKFSEKFQLFTPFSLGFEFRPGHEYYYISATPPNAVDRPCLRLKVYVRPTNETLYEAPEPIFTSNNSCSSPGGCRLFLSTIPVLWTLLGS

SEQ ID NO: 45094 - protein, 238 aa, Homo sapiens
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 45095 - protein, 212 aa, Homo sapiens
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASKDFEGENPQVPKLEKSISGTSPKREHLPLAVGIAFFLMTFLAS

SEQ ID NO: 45096 - protein, 233 aa, Homo sapiens
MRLLPLLRTVLWAAFLGSPLRGGSSLRHVVYWNSSNPSLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 45097 - protein, 193 aa, Homo sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERNLPSHPKEPESSQDPLEEEGSLLPALGVPIQTDKMEH

SEQ ID NO: 45098 - protein, 201 aa, Homo sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERKSESAHPVGSPGESGTSGWRGGDTPSPLCLLLLLLLLILRLLRIL

SEQ ID NO: 45099 - protein, 207 aa, Homo sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERRARVLPRSPGGGGIPAACTGGANSDRQDGALMGEIRGSEVTLAGACPLITG

SEQ ID NO: 45100 - protein, 346 aa, Homo sapiens
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 45101 - protein, 340 aa, Homo sapiens
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 45102 - protein, 259 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVTESHSVTQAGVQWRDLSSLQPRPPGFKLFFHLSLLRSWDYRHAPPPPANFYIFSRDSVSPCLPDWSRAPDNR

SEQ ID NO: 45103 - protein, 762 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 45104 - protein, 896 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 45105 - protein, 573 aa, Homo sapiens
MILMVRDCLKSQHRDPHCDPSDKREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 45106 - protein, 822 aa, Homo sapiens
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 45107 - protein, 121 aa, Homo sapiens
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLES

SEQ ID NO: 45108 - protein, 68 aa, Homo sapiens
MNGHISNHPSSFGMYPSQMNGYGSSPTFSQTDREHGSKTSAKALYEQRKNYARDSVSSVSDISQYRVE

SEQ ID NO: 45109 - protein, 562 aa, Homo sapiens
MMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 45110 - protein, 562 aa, Homo sapiens; identical to SEQ ID NO: 45109

SEQ ID NO: 45111 - protein, 691 aa, Homo sapiens
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKTSGGPKEISDGGSAR

SEQ ID NO: 45112 - protein, 68 aa, Homo sapiens; identical to SEQ ID NO: 45108

SEQ ID NO: 45113 - protein, 822 aa, Homo sapiens; identical to SEQ ID NO: 45106

SEQ ID NO: 45114 - protein, 822 aa, Homo sapiens; identical to SEQ ID NO: 45106

SEQ ID NO: 45115 - protein, 67 aa, Homo sapiens
MNGHISNHPSSFGMYPSQMNGYGSSPTFSQTDREHGSKTSAKALYEQRKNYARDSVSSVSDISQYRV

SEQ ID NO: 45116 - protein, 128 aa, Homo sapiens
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENF

SEQ ID NO: 45117 - protein, 331 aa, Homo sapiens
MRFRFGVVVPPAVAGARPELLVVGSRPELGRWEPRGAVRLRPAGTAAGDGALALQEPGLWLGEVELAAEEAAQDGAEIGATPKLPSTIFPWFVLRQGLILGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 45118 - protein, 331 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 45119 - protein, 317 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEAASQDTFPL

SEQ ID NO: 45120 - protein, 237 aa, Homo sapiens
  MOD_RES (1)..(1): Any amino acid
XDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEAASQDTFPL

SEQ ID NO: 45121 - protein, 170 aa, Homo sapiens
  MOD_RES (1)..(1): Any amino acid
XNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEDEKRTADMCCSGMWEETADFGLGILDYLKQK

SEQ ID NO: 45122 - protein, 270 aa, Homo sapiens
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEDEKRTADMCCSGMWEETADFGLGILDYLKQK

SEQ ID NO: 45123 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 45124 - protein, 157 aa, Homo sapiens
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 45125 - protein, 141 aa, Homo sapiens
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCFIMRIVMERSITTAIPTSWAGSASASASSSAFSIWS

SEQ ID NO: 45126 - protein, 3 aa, Homo sapiens
MLV

SEQ ID NO: 45127 - protein, 167 aa, Homo sapiens
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 45128 - protein, 167 aa, Homo sapiens; identical to SEQ ID NO: 45127

SEQ ID NO: 45129 - protein, 163 aa, Homo sapiens
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 45130 - protein, 677 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 45131 - protein, 659 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 45132 - protein, 681 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 45133 - protein, 608 aa, Homo sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSV

SEQ ID NO: 45134 - protein, 717 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 45135 - protein, 307 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 45136 - protein, 410 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGSLLVFSRHLRVYEKILTPIWPSSTDLEKPHEMLFLNVILFSLTVFTLISTAHTLDRAVRSDWLLLVLIYACLEELIPELIFNLYCQGNATLFF

SEQ ID NO: 45137 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 45138 - protein, 455 aa, Homo sapiens; identical to SEQ ID NO: 45137

SEQ ID NO: 45139 - protein, 161 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKII

SEQ ID NO: 45140 - protein, 136 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLP

SEQ ID NO: 45141 - protein, 502 aa, Homo sapiens
MKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 45142 - protein, 489 aa, Homo sapiens
MEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 45143 - protein, 502 aa, Homo sapiens [sequence omitted]

SEQ ID NO: 45144 - protein, 555 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 45145 - protein, 550 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 45146 - protein, 576 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 45147 - protein, 662 aa, Homo sapiens
MGDQSWLWNQAAPGVRSPVFACSVEKGNVPLVLSEHLAHSRDPGSGAVRFLISPEPWASAILGTSGLLASPVLPAALDAVTCQHLPQPSSGSRPISPRIGALCPLLLQPGTMSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 45148 - protein, 536 aa, Homo sapiens
MSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 45149 - protein, 641 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSPEASLCPQHRTGAPLGQSEELQPLSQRHPFLPHLGLASRPNGDWSQPCLTCDRAARATSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 45150 - protein, 584 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 45151 - protein, 356 aa, Homo sapiens
MSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 45152 - protein, 584 aa, Homo sapiens; identical to SEQ ID NO: 45150

SEQ ID NO: 45153 - protein, 484 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSPEASLCPQHRTGAPLGQSEELQPLSQRHPFLPHLGLASRPNGDWSQPCLTCDRAARATSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTGMQGLTGLLFTMEI

SEQ ID NO: 45154 - protein, 499 aa, Homo sapiens
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGMQGLTGLLFTMEI

SEQ ID NO: 45155 - protein, 632 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQSSILDLADIFVPALAPPSTHCSADPWDIPGFRPNTEASGSSWGPSADPWSPIPSGTVLSRSQPWDLTPMLSSSEPWGRTPVLPAGPPTTDPWALNSPHHKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPSPTNPFGAGEPGRPTLNQMRTGSPALGLAGGPVGAPLGSMTYSASLPLPLSSVPAGLTLPASVSVFPQAGAFAPQPLLPTPSSAGPRPPPPQTGTNPFL

SEQ ID NO: 45156 - protein, 318 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQAPPTSEPRLPLPSTVLHPGLG

SEQ ID NO: 45157 - protein, 574 aa, Homo sapiens
MALETLPRLCRPAAAQVGGSPQRLLGLGLGPREPALEPHVEPKDAAALLTRQPILQDCDLATVALSPPPPAGARATHLQVSSHDDLRTPAPGEEHRAQLLRGRNQVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKEVRSWQGDGSPMANGAGAVVHHQRDREPEREERKEEEKLKTSQSSILDLADIFVPALAPPSTHCSADPWDIPGFRPNTEASGSSWGPSADPWSPIPSGTVLSRSQPWDLTPMLSSSEPWGRTPVLPAGPPTTDPWALNSPHHKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPPRLRTRGWAGRRC

SEQ ID NO: 45158 - protein, 168 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGF

SEQ ID NO: 45159 - protein, 11 aa, Homo sapiens
MTTSALRRQVK

SEQ ID NO: 45160 - protein, 136 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKD

SEQ ID NO: 45161 - protein, 51 aa, Homo sapiens
MTTSALRRQVKNIVHNYSEAEIKVREATSNDPWGPPSSLMSEIADLTFNTV

SEQ ID NO: 45162 - protein, 108 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKD

SEQ ID NO: 45163 - protein, 660 aa, Homo sapiens [sequence omitted]

SEQ ID NO: 45164 - protein, 250 aa, Homo sapiens
MGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKEVRSWQGDGSPMANGAGAVVHHQRDREPEREERKEEEKLKTSQVLGRTQRPVDPPGGLLQTPGLRSPQEPSCPEASPGI

SEQ ID NO: 45165 - protein, 229 aa, Homo sapiens
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 45166 - protein, 275 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNK

SEQ ID NO: 45167 - protein, 232 aa, Homo sapiens
MIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFSISRCGPRG

SEQ ID NO: 45168 - protein, 348 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 45169 - protein, 348 aa, Homo sapiens; identical to SEQ ID NO: 45168

SEQ ID NO: 45170 - protein, 339 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 45171 - protein, 152 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGLENDFSQESS

SEQ ID NO: 45172 - protein, 339 aa, Homo sapiens; identical to SEQ ID NO: 45170

SEQ ID NO: 45173 - protein, 206 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGKKVSPEHAVLKQGSWNPASLHCLKPGCLQGVMVTYGQEMLKNLVLRSWSQRSSWRMLIAMQQDP

SEQ ID NO: 45174 - protein, 152 aa, Homo sapiens; identical to SEQ ID NO: 45171

SEQ ID NO: 45175 - protein, 1412 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 45176 - protein, 1302 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 45177 - protein, 1340 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEGIFVTRVQPEGPASKLLQPGDKIIQANGYSFINIEHGQAVSLLKTFQNTVELIIVREVSS

SEQ ID NO: 45178 - protein, 1346 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDANGYSFINIEHGQAVSLLKTFQNTVELIIVREVSS

SEQ ID NO: 45179 - protein, 1360 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 45180 - protein, 1371 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 45181 - protein, 1302 aa, Homo sapiens; identical to SEQ ID NO: 45176

SEQ ID NO: 45182 - protein, 1419 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKSMLSRSFNSNFTTVSSFHCGSSRDLHGSQGSLALSVADRRGSGGHIFRMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 45183 - protein, 385 aa, Homo sapiens
MKEEEGFPEDEATESETLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 45184 - protein, 377 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 45185 - protein, 220 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHL

SEQ ID NO: 45186 - protein, 71 aa, Homo sapiens
MRRLNRKKTLSLVKELDAFPKVPESYVETSASGGTVSLIAFTTMALLTIMEFSVYQDTWMKYEYEVDKDFS

SEQ ID NO: 45187 - protein, 175 aa, Homo sapiens
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGH

SEQ ID NO: 45188 - protein, 385 aa, Homo sapiens
MPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 45189 - protein, 475 aa, Homo sapiens
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 45190 - protein, 475 aa, Homo sapiens; identical to SEQ ID NO: 45189

SEQ ID NO: 45191 - protein, 864 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKLAEKTEDLIRMRKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45192 - protein, 775 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVETWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45193 - protein, 641 aa, Homo sapiens
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45194 - protein, 831 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45195 - protein, 827 aa, Homo sapiens
RARAARSQNAVGPVPAAPSPEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45196 - protein, 720 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEGVSTLST

SEQ ID NO: 45197 - protein, 864 aa, Homo sapiens; identical to SEQ ID NO: 45191

SEQ ID NO: 45198 - protein, 588 aa, Homo sapiens
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTVKGGISETRIEKRIVITGDADIDHDQVLVQAIKEAKEQHPDMSVTKVVVHQETEIADE

SEQ ID NO: 45199 - protein, 704 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45200 - protein, 767 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 45201 - protein, 714 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEG

SEQ ID NO: 45202 - protein, 686 aa, Homo sapiens
MGCFCAVPEEFYCEVLLLDESKLTLTTQQQGIKKSTKGSVVLDHVFHHVNLVEIDYFGLRYCDRSHQTYWLDPAKTLAEHKELINTGPPYTLYFGIKFYAEDPCKLKEEITRYQFFLQVKQDVLQGRLPCPVNTAAQLGAYAIQSELGDYDPYKHTAGYVSEYRFVPDQKEELEEAIERIHKTLMGQIPSEAELNYLRTAKSLEMYGVDLHPVYGENKSEYFLGLTPVGVVVYKNKKQVGKYFWPRITKVHFKETQFELRVLGKDCNETSFFFEARSKTACKHLWKCSVEHHTFFRMPENESNSLSRKLSKFGSIRYKHRYSGRTALQMSRDLSIQLPRPDQNVTRSRSKTYPKRIAQTQPAESNSISRITANMENGENEGTIKIIAPSPVKSFKKAKNENSPDTQRSKSHAPWEENGPQSGLYNSPSDRTKSPKFPYTRRRNPSCGSDNDSVQPVRRRKAHNSGEDSDLKQRRRSRSRCNTSSGSESENSNREYRKKRNRIRQENDMVDSAPQWEAVLRRQKEKNQADPNNRRSRHRSRSRSPDIQAKEELWKHIQKELVDPSGLSEEQLKEIPYTKIETQGDPIRIRHSHSPRSYRQYRRSQCSDGERSVLSEVNSKTDLVPPLPVTRSSDAQGSGDATVHQRRNGSKDSLMEEKPQTSTNNLAGKHTAKTIKTIQASRLKTET

SEQ ID NO: 45203 - protein, 611 aa, Homo sapiens
MDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVHSADHLHHPETCFSGSQCRDTPAGTGEREDDEKTVDDRTVKFSPCHLEDGMVPSVRLLSSGFVCSL

SEQ ID NO: 45204 - protein, 440 aa, Homo sapiens
MKFLLIKDAPGKKKRKNLMLSFKRKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 45205 - protein, 518 aa, Homo sapiens
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 45206 - protein, 900 aa, Homo sapiens
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVSTVQTIYTTRKPVSLAASAETLRQELEREKMMKRLLMTEL

SEQ ID NO: 45207 - protein, 733 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPQSGAMSNGLAGCEMLLTGKEGHGNKDGISLISPPAPFLVDAVTSSGPILAEEAVLKQKCLLTTEL

SEQ ID NO: 45208 - protein, 505 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKWLSAASDCCQRGGNQWNTRALPPPQTAHRNYTDFVHEHNVKNAGIRHDVHFPGHTAMTEI

SEQ ID NO: 45209 - protein, 505 aa, Homo sapiens; identical to SEQ ID NO: 45208

SEQ ID NO: 45210 - protein, 687 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPLWSHFGRRSCPEAEVFTDH

SEQ ID NO: 45211 - protein, 732 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPSGAMSNGLAGCEMLLTGKEGHGNKDGISLISPPAPFLVDAVTSSGPILAEEAVLKQKCLLTTEL

SEQ ID NO: 45212 - protein, 779 aa, Homo sapiens
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45213 - protein, 881 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45214 - protein, 958 aa, Homo sapiens
MSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANESQRTQDISQRDLVPEPGAAAGLEVFTQKSLAASPEGSEHWVFIEREYTRPEELGLLKVTTMQQEERQAGLAGILANGRLSKVDVLVDKFKVEVATEEMVGNRRANTQQQGKMIASPEDFESVGEEGPWIRESPGGAALASGRTLAEKLLEGSELRADTREATIRNRCMSDGQPEGQTELRKGLEEPHTCGRPTAPGTRPAEVDVLSPASDKGGLQSFLLDPAHAEARAELSNETDTSFAERSFYLNYEEKDSEDQVLPPPLEERKGRLDAPPGGEPRPTLNSLDLRVSAAASSRSKDEAHMTSPKEGAGTPKNHGGPGDLKGSPAGQTFAEGWEDAQWGVEGEFPHLTASAAREEGTPVSGDLLGKAEESPTEELKKHPPHRGQGVHPDPQACALPRAIPLNVRKPVKPDRGNFPPKERGVVPTQKGGAELKDREASAFLHMEVIIPLPASPGHSEDLAALEEASPSPTSHGSGEPSELREPFLRHVHLSKASPEPKDQVGFVVSPATGGERRPPPITSRKPRVVPEEAEGRIPLGFGFPSGKRREMTSFQAGDQEGSLEDISKTSVANKIRIFETHGAETRRMSEGEARSLPNDVSSEAPVGQAEQQRSTLSDLGFAQLQPPGDFASPKATHSTVIPLATRHFREDTSASYQEAHTELEPVSPNSGCETTLAEATGTGNKSGDAVREEKRSTNLAANTPGKGGRLRFASPSGPQRAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQD

SEQ ID NO: 45215 - protein, 880 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45216 - protein, 199 aa, Homo sapiens
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTY

SEQ ID NO: 45217 - protein, 701 aa, Homo sapiens
MVFLGRINEVEPAKGLAESLAPTERSVKSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45218 - protein, 772 aa, Homo sapiens
MEEKDYSEADGLSERTTPSKAQKSPQKIAKKYKSAICRVTLLDASEYECEVENWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45219 - protein, 772 aa, Homo sapiens; identical to SEQ ID NO: 45218

SEQ ID NO: 45220 - protein, 199 aa, Homo sapiens; identical to SEQ ID NO: 45216

SEQ ID NO: 45221 - protein, 794 aa, Homo sapiens [sequence omitted]

SEQ ID NO: 45222 - protein, 168 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWN

SEQ ID NO: 45223 - protein, 59 aa, Homo sapiens
MTTETGPDSEVKKAQEEAPQQPEAAAAVTTPVTPAGHGHPEANSNEKHPSQQDTRPAEQ

SEQ ID NO: 45224 - protein, 257 aa, Homo sapiens
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRF

SEQ ID NO: 45225 - protein, 37 aa, Homo sapiens
MEEKDYSEADGLSERTTPSKAQKSPQKIAKKYKSAIC

SEQ ID NO: 45226 - protein, 119 aa, Homo sapiens
  MOD_RES (1)..(1): Any amino acid
XSVGREFIATTPSITTETISTTMIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 45227 - protein, 779 aa, Homo sapiens; identical to SEQ ID NO: 45212

SEQ ID NO: 45228 - protein, 114 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVE

SEQ ID NO: 45229 - protein, 188 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDIT

SEQ ID NO: 45230 - protein, 234 aa, Homo sapiens
MESTPEPRPNEWEKRRITPLSLQTQGRKGDHLFKDILSVKEKYLMPTIWTVEEKAQETDKTRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQD

SEQ ID NO: 45231 - protein, 1005 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 45232 - protein, 1005 aa, Homo sapiens; identical to SEQ ID NO: 45231

SEQ ID NO: 45233 - protein, 673 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKTVKGGISETRIEKRIVITGDGDIDHDQALAQAIREAREQHPDMSVTRVVVHKETELAEEGED

SEQ ID NO: 45234 - protein, 633 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKSGQRLGKTKE

SEQ ID NO: 45235 - protein, 747 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 45236 - protein, 380 aa, Homo sapiens
  MOD_RES (1)..(1): Any amino acid
XLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGRKGDHLFKDILSVKEKYLMPTIWTVEEKAQETDKTRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQD

SEQ ID NO: 45237 - protein, 383 aa, Homo sapiens
MEEEETQLEEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 45238 - protein, 673 aa, Homo sapiens; identical to SEQ ID NO: 45233

SEQ ID NO: 45239 - protein, 153 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKE

SEQ ID NO: 45240 - protein, 747 aa, Homo sapiens; identical to SEQ ID NO: 45235

SEQ ID NO: 45241 - protein, 179 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKE

SEQ ID NO: 45242 - protein, 852 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 45243 - protein, 118 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPL

SEQ ID NO: 45244 - protein, 201 aa, Homo sapiens
MEEEETQLEEKNSLRVEGDNIYVRHSNLMLEELDKAQEDILKHQASISELKRNFMESTPEPRPNEWEKRRITPLSLQTQGTRAPESEGPCTGARDAVKPPVVKTEMVTISDASQRTEISTKEVPIVQTETKTITYESPQTVKGGISETRIEKRIVITGDGDIDHDQALAQAIREAREQHPDMSVTRVVVHKETELAEEGED

SEQ ID NO: 45245 - protein, 127 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKG

SEQ ID NO: 45246 - protein, 162 aa, Homo sapiens
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVE

SEQ ID NO: 45247 - protein, 1087 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 45248 - protein, 1087 aa, Homo sapiens; identical to SEQ ID NO: 45247

SEQ ID NO: 45249 - protein, 865 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 45250 - protein, 384 aa, Homo sapiens
MKHQTNISELKRTFLETSTDTAVTNEWEKRLSTSPVRLAARQEDAPMIEPLVPEETKEETEISEKVIFLQQGSAPFLESQTKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 45251 - protein, 756 aa, Homo sapiens
MQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 45252 - protein, 392 aa, Homo sapiens
MKHQTNISELKRTFLETSTDTAVTNEWEKRLSTSPVRLAARQEDAPMIEPLVPEEPSVIKKMQEGDSADSVVTSRQIIFQKTVPSTLETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 45253 - protein, 311 aa, Homo sapiens
RWQLGGAATAAAGGARVWRPLPASRSSFPPPSPRLDPGEFEGKSPCGGTCEQPYLSLPLRYFFSPRKVVPAGCEQAPGGAPKEGFGDSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGS

SEQ ID NO: 45254 - protein, 883 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQE

SEQ ID NO: 45255 - protein, 756 aa, Homo sapiens; identical to SEQ ID NO: 45251

SEQ ID NO: 45256 - protein, 721 aa, Homo sapiens
MGQGEPSQRSTGLAGLYAAPAASPVFIKGSGMDALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 45257 - protein, 619 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 45258 - protein, 691 aa, Homo sapiens
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 45259 - protein, 613 aa, Homo sapiens
MGQALGIKSCDFQAARNNEEHHTKALSSRRLFVRRGQPFTIILYFRAPVRAFLPALKKVALTAQTEDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 45260 - protein, 405 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 45261 - protein, 405 aa, Homo sapiens; identical to SEQ ID NO: 45260

SEQ ID NO: 45262 - protein, 541 aa, Homo sapiens
MIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLFGALVVRPVGCLEQLEGRCRGGKRPGRKSSRLLCRPPSPPILTPDSFPALQPPAPLTLVGTGPSSASGREVTPPLQLALTSARKPRASKPFAPALRLPQKPGLRVEMPPTHDPGPPPASRPRNGNSSTKPGTGQKLGLPPPLDGVKRPGLAHFGVSWLPALTYTHAPPHTLCSLKNVIYWGPPSCFPHLPLPYLTPPA

SEQ ID NO: 45263 - protein, 383 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQIYPYEMLVVTNKGRTKLPPGVDRMRLERHLSAEDFSRVFAMSPEEFGKLALWKRNELKKKASLF

SEQ ID NO: 45264 - protein, 383 aa, Homo sapiens; identical to SEQ ID NO: 45263

SEQ ID NO: 45265 - protein, 405 aa, Homo sapiens; identical to SEQ ID NO: 45260

SEQ ID NO: 45266 - protein, 358 aa, Homo sapiens
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQIYPYEMLVVTNKGRTKLPPGVDRMRLERHLSAEDFSRVFAMSPEEFGKLALWKRNELKKKASLF

SEQ ID NO: 45267 - protein, 383 aa, Homo sapiens; identical to SEQ ID NO: 45263

SEQ ID NO: 45268 - protein, 405 aa, Homo sapiens; identical to SEQ ID NO: 45260

SEQ ID NO: 45269 - protein, 365 aa, Homo sapiens
MERLQKAKMDNQVLGYKDLAAIPKDKAILDIERPDLMIYEPHFTYSLLEHVELPRSREVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 45270 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 45271 - protein, 854 aa, Homo sapiens
MALEQALQAARQGELDVLRSLHAAGLLGPSLRDPLDALPVHHAARAGKLHCLRFLVEEAALPAAARARNGATPAHDASATGHLACLQWLLSQGGCRVQDKDNSGATVLHLAARFGHPEVVNWLLHHGGGDPTAATDMGALPIHYAAAKGDFPSLRLLVEHYPEGVNAQTKNGATPLYLACQEGHLEVTQYLVQECGADPHARAHDGMTPLHAAAQMGHSPVIVWLVSCTDVSLSEQDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKPTPPPPPPSFPPPPPPPGTQLPPPPPGYPAPKPPVGPQAADIYMQTKNKLRHVETEALKKELSSCDGHDGLRRQDSSRKPRAFSKQPSTGDYYRQLGRCPGETLAARPGMAHSEEVRARQPARAGCPRLGPAARGSLEGPSAPPQAALLPGNHVPNGCAADPKASRELPPPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 45272 - protein, 288 aa, Homo sapiens
MAHSEEAALLPGNHVPNGCAADPKASRELPPPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 45273 - protein, 214 aa, Homo sapiens [sequence omitted]

SEQ ID NO: 45274 - protein, 188 aa, Homo sapiens
  MOD_RES (1)..(1): Any amino acid
XEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQI

SEQ ID NO: 45275 - protein, 444 aa, Homo sapiens
MARVGPGRAGVSCQGRGRGRGGSGQRRPPTWEISDSDAEDSAGSEAAARARDPAGERRAAAEALRLLRPEQVLKRLAVCVDTAILEDAGADVLMEALEALGCECRIEPQRPARSLRWTRASPDPCPRSLPPEVWAAGEQELLLLLEPEEFLQGVATLTQISGPTHWVPWISPETTARPHLAVIGLDAYLWYRSLSCPQQGWLGRGFRGGGLWQRPSSGRAGPMGSGEEWSPLLRSRQHVSRGTQQPESPKVAGAEVAVSWPEVEEVRACLSWALVLLQLWANLDVLLVASWQELSRHVCAVTKALAQYPLKCVMPRLKGGRITSRQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 45276 - protein, 386 aa, Homo sapiens
MARVGPGRAGVSCQGRGRGRGGSGQRRPPTWEISDSDAEDSAGSEAAARARDPAGERRAAAEALRLLRPEQVLKRLAVCVDTAILEDAGADVLMEALEALGCECRIEPQRPARSLRWTRASPDPCPRSLPPEVWAAGEQELLLLLEPEEFLQGVATLTQISGPTHWVPWISPETTARPHLAVIGLDAYLWSRQHVSRGTQQPESPKVAGAEVAVSWPEVEEVRACLSWALVLLQLWANLDVLLVASWQELSRHVCAVTKALAQYPLKCVMPRLKGGRITSRQYRESQAFSFCTAGRWAAGEPVARDGAGLQAAWRRQIRQFSRVSPAVADAVVTAFPSPRLLQQALEACSTERERMGLLAVGPDLSRRICLFLTTANPDLLLDLGS

SEQ ID NO: 45277 - protein, 840 aa, Homo sapiens
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCTQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSSAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVGWKKERILAEYPDGRIIMVLPEDPKYALKKVDEIREMVDNDLGFQQAPLMCYSRTKTLLFISNDKKVVGCLIAEHIQWGYRVIEEKLPVIRSEEEKVRFERQKAWCCSTLPEPAICGISRIWVFSMMRRKKIASRMIECLRSNFIYGSYLSKEEIAFSDPTPDGKLFATQYCGTGQFLVYNFINGQNST

SEQ ID NO: 45278 - protein, 701 aa, Homo sapiens
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCTQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSSAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVVLLINHHECGSEEEFITSLFLSMFNFRYTQRSFSFPIRFLEGLEERKNSG

SEQ ID NO: 45279 - protein, 601 aa, Homo sapiens
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAENNSNAPRVLSQKIKPQVTLQGGAAFFVRKKSSLRKSSLENEPSLGRTQKSKSEVIEDSDVETVSEKKTFATRQVPKCLVLEEKLKIGLLSASSKNKEKLIKDSSDDRVSSKEHKVDKNEAFSSEDSLGENKTISPKSTVYPIFSASSVNSKRSLGEEQFSVGSVNFMKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDGKLFATKYCNTPNFLVYNFNS

SEQ ID NO: 45280 - protein, 239 aa, Homo sapiens
MKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDDCRRLNRYQET

SEQ ID NO: 45281 - protein, 282 aa, Homo sapiens
MALKQISSNKCFGGLQKVFEHDSVELNCKMKFAVYLPPKAETGKCPALYWLSGLTCTEQNFISKSGYHQSASEHGLVVIAPDTSPRGCNIKGEDESWDFGTGAGFYVDATEDPWKTNYRMYSYVTEELPQLINANFPVDPQRMSIFGHSMGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEGYDHSYYFIATFITDHIRHHAKYLNA

SEQ ID NO: 45282 - protein, 213 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 45283 - protein, 213 aa, Homo sapiens; identical to SEQ ID NO: 45282

SEQ ID NO: 45284 - protein, 197 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEA

SEQ ID NO: 45285 - protein, 258 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRSRTNVCLLCSLLFHHPTPTSTPYINQSVKIERVSLGQWSYGKSKEQQKLADREKRAAEQQRKKMEKEAQRLMKKEQNKIGVKLS

SEQ ID NO: 45286 - protein, 78 aa, Homo sapiens
MAITQFRLFKFCTCLATVFSFLKRLICRSGRGRKLSGDQITLPTTVDYSSVPKQTDVEEWTSWDEDAPTSVKIEGGNG

SEQ ID NO: 45287 - protein, 423 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 45288 - protein, 423 aa, Homo sapiens; identical to SEQ ID NO: 45287

SEQ ID NO: 45289 - protein, 422 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 45290 - protein, 109 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQG

SEQ ID NO: 45291 - protein, 500 aa, Homo sapiens
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKAWARADSLQEWRPLEQVPSPLHRATKRQHVHFLTPLPPPPSVAWVGTAQAGYHLEVFLPQRAGWPRAA

SEQ ID NO: 45292 - protein, 508 aa, Homo sapiens
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKHLWLTM

SEQ ID NO: 45293 - protein, 500 aa, Homo sapiens; identical to SEQ ID NO: 45291

SEQ ID NO: 45294 - protein, 508 aa, Homo sapiens; identical to SEQ ID NO: 45292

SEQ ID NO: 45295 - protein, 508 aa, Homo sapiens
MLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKH

SEQ ID NO: 45296 - protein, 433 aa, Homo sapiens
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKV

SEQ ID NO: 45297 - protein, 436 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKVC

SEQ ID NO: 45298 - protein, 435 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 45299 - protein, 435 aa, Homo sapiens; identical to SEQ ID NO: 45298

SEQ ID NO: 45300 - protein, 435 aa, Homo sapiens; identical to SEQ ID NO: 45298

SEQ ID NO: 45301 - protein, 435 aa, Homo sapiens; identical to SEQ ID NO: 45298

SEQ ID NO: 45302 - protein, 435 aa, Homo sapiens; identical to SEQ ID NO: 45298

SEQ ID NO: 45303 - protein, 435 aa, Homo sapiens; identical to SEQ ID NO: 45298

SEQ ID NO: 45304 - protein, 442 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPLLWSDPADNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 45305 - protein, 458 aa, Homo sapiens
MDSVELCLPESFSLHYEEELLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 45306 - protein, 56 aa, Homo sapiens
MSNKDRHIDSSCSSFIKTEPSSPASLTDSVNHHSPGGSSDASGSYSSTMNGHQNGL

SEQ ID NO: 45307 - protein, 92 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTK

SEQ ID NO: 45308 - protein, 354 aa, Homo sapiens
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANS

SEQ ID NO: 45309 - protein, 50 aa, Homo sapiens
MSNKDRHIDSSCSSFIKTEPSSPASLTDSVNHHSPGGSSDASGSYSSTMN

SEQ ID NO: 45310 - protein, 435 aa, Homo sapiens; identical to SEQ ID NO: 45298

SEQ ID NO: 45311 - protein, 435 aa, Homo sapiens; identical to SEQ ID NO: 45298

SEQ ID NO: 45312 - protein, 435 aa, Homo sapiens; identical to SEQ ID NO: 45298

SEQ ID NO: 45313 - protein, 470 aa, Homo sapiens
MWRECDWGLGAVKSDLACVPSAKRLLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPLLWSDPADNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 45314 - protein, 452 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALASHFFWGLWALIQAKYSTIEFDFLGYAIVRFNQYFKMKPEVTALKVPE

SEQ ID NO: 45315 - protein, 258 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFSLSSLTLCKGKTTRCFGLTGCRGSRLLLSFF

SEQ ID NO: 45316 - protein, 434 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALGENLNFIIGNKYCQLFSLKWLLISFGDCGL

SEQ ID NO: 45317 - protein, 208 aa, Homo sapiens
MAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 45318 - protein, 317 aa, Homo sapiens
MEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 45319 - protein, 394 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALGPSCVSSTMTASLQCCRVGNRHGEIARLTLSGLFPGVSLLLGSLGPHPEPVLHHRL

SEQ ID NO: 45320 - protein, 386 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 45321 - protein, 252 aa, Homo sapiens
RRLGGGTAEGKTGRGLGGPSWDTGPRAMGSLSRPSFSDRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 45322 - protein, 254 aa, Homo sapiens
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 45323 - protein, 339 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKPGKAYLFQLRLFSLVVFLSNRLFHKTVYLQSALSSSTSAEKFPSPHPSPAKLKATAGH

SEQ ID NO: 45324 - protein, 261 aa, Homo sapiens
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKVAAFSLSSFLYSLSAPMKQRPAKHISSSCASSPWWSS

SEQ ID NO: 45325 - protein, 300 aa, Homo sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 45326 - protein, 300 aa, Homo sapiens; identical to SEQ ID NO: 45325

SEQ ID NO: 45327 - protein, 322 aa, Homo sapiens
MGLPERRGLVLLLSLAEILFKIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 45328 - protein, 300 aa, Homo sapiens; identical to SEQ ID NO: 45325

SEQ ID NO: 45329 - protein, 277 aa, Homo sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 45330 - protein, 184 aa, Homo sapiens [sequence omitted]

SEQ ID NO: 45331 - protein, 155 aa, Homo sapiens
MDLWNWDEASPQEVPPGNKLAGLEGAKLGFCFPDLALQGDTPTATAETCWKGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 45332 - protein, 342 aa, Homo sapiens
MDLWNWDEASPQEVPPGNKLAGLEGAKLGFCFPDLALQGDTPTATAETCWKGTSSSLASFPQLDWGSALLHPEVPWGAEPDSQALPWSGDWTDMACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 45333 - protein, 342 aa, Homo sapiens; identical to SEQ ID NO: 45332

SEQ ID NO: 45334 - protein, 143 aa, Homo sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGKIQTLLVGN

SEQ ID NO: 45335 - protein, 512 aa, Homo sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGVVPQSAPPVPTASSRFHFPPLDTHSPTNDVQPGRFSASSLTASGQESSNGTDRKTELSELEDGSAADWRRGVDPVSSRNAIGGGGIGHQKRKPDIMLPLFARPGMYPDPHSPFAVSPIPGRGGVLNVPISPALSLTPTIFSYSPSPGLSPFTSSSCFSFNPEEMKHYLHSQACSVFNYHLSPRTFPRYPGLMVPPLQCQMHPEESTQFSIKLQPPPVGRKNRERVESSEESAPVTTPTMASIPPRIKVEPASEKDPESLRQSAREKEEHTQEEGTVPSRTIEEEKGTIFARPAAPPIWPSVPISTPSGEPLEVTEDSEDRPGKEPSAPEKKEDALMPPKLRLKRRWNDDPEARELSKSGKFLWNGSGPQGLATAAADA

SEQ ID NO: 45336 - protein, 510 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 45337 - protein, 132 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFK

SEQ ID NO: 45338 - protein, 140 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTP

SEQ ID NO: 45339 - protein, 510 aa, Homo sapiens; identical to SEQ ID NO: 45336

SEQ ID NO: 45340 - protein, 150 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLF

SEQ ID NO: 45341 - protein, 552 aa, Homo sapiens
MSERRCPPEHREGVNDTGGSLFPQKLLNAETSQSGIRDAESTMDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 45342 - protein, 452 aa, Homo sapiens
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 45343 - protein, 317 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRNGLQLIFIFIWSFQ

SEQ ID NO: 45344 - protein, 341 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 45345 - protein, 264 aa, Homo sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEDCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 45346 - protein, 286 aa, Homo sapiens
MQEGELAISPISPVAAMPPLGTHVQARCEAQINLLGEGGICKLPGRLRDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 45347 - protein, 190 aa, Homo sapiens
MDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 45348 - protein, 548 aa, Homo sapiens
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 45349 - protein, 473 aa, Homo sapiens
MNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 45350 - protein, 825 aa, Homo sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKIQKTSKVYTESQETQRSQTIL

SEQ ID NO: 45351 - protein, 1153 aa, Homo sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKVISA

SEQ ID NO: 45352 - protein, 1298 aa, Homo sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 45353 - protein, 808 aa, Homo sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQFCRLGSPRSRGCLW

SEQ ID NO: 45354 - protein, 1233 aa, Homo sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45355 - protein, 1176 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45356 - protein, 1210 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45357 - protein, 1176 aa, Homo sapiens; identical to SEQ ID NO: 45355

SEQ ID NO: 45358 - protein, 1210 aa, Homo sapiens; identical to SEQ ID NO: 45356

SEQ ID NO: 45359 - protein, 1267 aa, Homo sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45360 - protein, 1267 aa, Homo sapiens; identical to SEQ ID NO: 45359

SEQ ID NO: 45361 - protein, 1233 aa, Homo sapiens; identical to SEQ ID NO: 45354

SEQ ID NO: 45362 - protein, 1267 aa, Homo sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45363 - protein, 298 aa, Homo sapiens
  MOD_RES (1)..(1): Any amino acid
XSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQGQLPPPSLPSHPQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRN

SEQ ID NO: 45364 - protein, 1210 aa, Homo sapiens
MAAAAGAAAAAAAEGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45365 - protein, 298 aa, Homo sapiens; identical to SEQ ID NO: 45363
  MOD_RES (1)..(1): Any amino acid

SEQ ID NO: 45366 - protein, 1176 aa, Homo sapiens; identical to SEQ ID NO: 45355

SEQ ID NO: 45367 - protein, 1267 aa, Homo sapiens; identical to SEQ ID NO: 45359

SEQ ID NO: 45368 - protein, 1210 aa, Homo sapiens; identical to SEQ ID NO: 45364

SEQ ID NO: 45369 - protein, 298 aa, Homo sapiens; identical to SEQ ID NO: 45363
  MOD_RES (1)..(1): Any amino acid

SEQ ID NO: 45370 - protein, 922 aa, Homo sapiens
SEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45371 - protein, 1233 aa, Homo sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45372 - protein, 1233 aa, Homo sapiens; identical to SEQ ID NO: 45354

SEQ ID NO: 45373 - protein, 1210 aa, Homo sapiens; identical to SEQ ID NO: 45356

SEQ ID NO: 45374 - protein, 298 aa, Homo sapiens; identical to SEQ ID NO: 45363
  MOD_RES (1)..(1): Any amino acid

SEQ ID NO: 45375 - protein, 1267 aa, Homo sapiens; identical to SEQ ID NO: 45359

SEQ ID NO: 45376 - protein, 888 aa, Homo sapiens
SEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45377 - protein, 1176 aa, Homo sapiens
MAAAAGAAAAAAAEGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45378 - protein, 1031 aa, Homo sapiens
SCHCTPSWPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNVSERLVEEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45379 - protein, 1233 aa, Homo sapiens; identical to SEQ ID NO: 45354

SEQ ID NO: 45380 - protein, 1267 aa, Homo sapiens; identical to SEQ ID NO: 45362

SEQ ID NO: 45381 - protein, 298 aa, Homo sapiens; identical to SEQ ID NO: 45363
  MOD_RES (1)..(1): Any amino acid

SEQ ID NO: 45382 - protein, 298 aa, Homo sapiens; identical to SEQ ID NO: 45363
  MOD_RES (1)..(1): Any amino acid

SEQ ID NO: 45383 - protein, 1210 aa, Homo sapiens; identical to SEQ ID NO: 45356

SEQ ID NO: 45384 - protein, 1176 aa, Homo sapiens; identical to SEQ ID NO: 45355

SEQ ID NO: 45385 - protein, 1233 aa, Homo sapiens; identical to SEQ ID NO: 45371

SEQ ID NO: 45386 - protein, 298 aa, Homo sapiens; identical to SEQ ID NO: 45363
  MOD_RES (1)..(1): Any amino acid

SEQ ID NO: 45387 - protein, 1176 aa, Homo sapiens; identical to SEQ ID NO: 45377

SEQ ID NO: 45388 - protein, 888 aa, Homo sapiens; identical to SEQ ID NO: 45376

SEQ ID NO: 45389 - protein, 922 aa, Homo sapiens; identical to SEQ ID NO: 45370

SEQ ID NO: 45390 - protein, 1031 aa, Homo sapiens
SCHCTPSRPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNVSERLVEEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 45391 - protein, 1031 aa, Homo sapiens; identical to SEQ ID NO: 45378

SEQ ID NO: 45392 - protein, 1031 aa, Homo sapiens; identical to SEQ ID NO: 45378

SEQ ID NO: 45393 - protein, 1031 aa, Homo sapiens; identical to SEQ ID NO: 45390

SEQ ID NO: 45394 - protein, 1031 aa, Homo sapiens; identical to SEQ ID NO: 45378

SEQ ID NO: 45395 - protein, 725 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPQVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHGHSYSNRKYESDEDSLGSSGRVCVEKWNLLNSSRLHLPRASAVALEVQRLNALDLEKKIGKSILGKVHLAMVRYHEGGRFCEKGEEWDQESAVFHLEHAANLGELEAIVGLGLMYSQLPHHILADVSLKETEENKTKGFDYLLKAAEAGDRQSMILVARAFDSGQNLSPDRCQDWLEALHWYNTALEMTDCDEGGEYDGMQDEPRYMMLAREAEMLFTGGYGLEKDPQRSGDLYTQAAEAAMEAMKGRLANQYYQKAEEAWAQMEE

SEQ ID NO: 45396 - protein, 462 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 45397 - protein, 462 aa, Homo sapiens; identical to SEQ ID NO: 45396

SEQ ID NO: 45398 - protein, 462 aa, Homo sapiens; identical to SEQ ID NO: 45396

SEQ ID NO: 45399 - protein, 145 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGV

SEQ ID NO: 45400 - protein, 426 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVPSGDWCSPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGKSLCCS

SEQ ID NO: 45401 - protein, 441 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 45402 - protein, 107 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTS

SEQ ID NO: 45403 - protein, 111 aa, Homo sapiens
MGKEKTHINIVVIGHVDSGKSTTTGHLIYKCGGIDKRTIEKFEKEAAEMGKGSFKYAWVLDKLKAERERGITIDISLWKFETTKQWTRRLLELARSPSLPRKLRRLNEYYP

SEQ ID NO: 45404 - protein, 463 aa, Homo sapiens
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 45405 - protein, 463 aa, Homo sapiens; identical to SEQ ID NO: 45404

SEQ ID NO: 45406 - protein, 225 aa, Homo sapiens
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 45407 - protein, 225 aa, Homo sapiens; identical to SEQ ID NO: 45406

SEQ ID NO: 45408 - protein, 225 aa, Homo sapiens; identical to SEQ ID NO: 45406

SEQ ID NO: 45409 - protein, 123 aa, Homo sapiens
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERL

SEQ ID NO: 45410 - protein, 281 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45411 - protein, 631 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVGGRQGGDRLAGGGDHQV

SEQ ID NO: 45412 - protein, 575 aa, Homo sapiens
MNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45413 - protein, 281 aa, Homo sapiens; identical to SEQ ID NO: 45410

SEQ ID NO: 45414 - protein, 281 aa, Homo sapiens; identical to SEQ ID NO: 45410

SEQ ID NO: 45415 - protein, 647 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45416 - protein, 647 aa, Homo sapiens; identical to SEQ ID NO: 45415

SEQ ID NO: 45417 - protein, 257 aa, Homo sapiens
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45418 - protein, 181 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWS

SEQ ID NO: 45419 - protein, 63 aa, Homo sapiens
MRSGKASCTLETVWEDKHKYEEAERRFYEHEATQAAASAQQLPAEGPAMNGPGQDDPEDADEA

SEQ ID NO: 45420 - protein, 39 aa, Homo sapiens
MATNFLAHEKIWFDKFKYDDAERRFYEQMNGPVAGASRQ

SEQ ID NO: 45421 - protein, 81 aa, Homo sapiens
MRSGKASCTLETVWEDKHKYEEAERRFYEHEATQAAASAQQLPAEGPAMNGPGQDDPEDADEAEAPDGGSRRDPRKSQDSR

SEQ ID NO: 45422 - protein, 37 aa, Homo sapiens
MRSGKASCTLETVWEDKHKYEEAERRFYEHEATQAAA

SEQ ID NO: 45423 - protein, 53 aa, Homo sapiens
MRSGKASCTLETVWEDKHKYEEAERRFYEHEATQAAASAQQLPAEGPAMNGPG

SEQ ID NO: 45424 - protein, 63 aa, Homo sapiens
MATNFLAHEKIWFDKFKYDDAERRFYEQMNGPVAGASRQENGASVILRDIARARENIQKSLAG

SEQ ID NO: 45425 - protein, 300 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPS

SEQ ID NO: 45426 - protein, 21 aa, Homo sapiens
MRSGKASCTLETVWEDKHKYE

SEQ ID NO: 45427 - protein, 157 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACH

SEQ ID NO: 45428 - protein, 257 aa, Homo sapiens; identical to SEQ ID NO: 45417

SEQ ID NO: 45429 - protein, 281 aa, Homo sapiens; identical to SEQ ID NO: 45410

SEQ ID NO: 45430 - protein, 146 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWG

SEQ ID NO: 45431 - protein, 204 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKP

SEQ ID NO: 45432 - protein, 129 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKL

SEQ ID NO: 45433 - protein, 166 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEE

SEQ ID NO: 45434 - protein, 84 aa, Homo sapiens
MRSGKASCTLETVWEDKHKYEEAERRFYEHEATQAAASAQQLPAEGPAMNGPGQDDPEDADEAEAPDGGSRRDPRKSQDSRKPL

SEQ ID NO: 45435 - protein, 199 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSIL

SEQ ID NO: 45436 - protein, 257 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPG

SEQ ID NO: 45437 - protein, 179 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVE

SEQ ID NO: 45438 - protein, 35 aa, Homo sapiens
MATNFLAHEKIWFDKFKYDDAERRFYEQMNGPVAG

SEQ ID NO: 45439 - protein, 49 aa, Homo sapiens
MRSGKASCTLETVWEDKHKYEEAERRFYEHEATQAAASAQQLPAEGPAM

SEQ ID NO: 45440 - protein, 39 aa, Homo sapiens; identical to SEQ ID NO: 45420

SEQ ID NO: 45441 - protein, 190 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDG

SEQ ID NO: 45442 - protein, 697 aa, Homo sapiens
MEAPLGSILSPCPGRAATGRAGTGRVGTGLRPPAVLQLCPLLAFYRCVRKMRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45443 - protein, 204 aa, Homo sapiens; identical to SEQ ID NO: 45431

SEQ ID NO: 45444 - protein, 168 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEED

SEQ ID NO: 45445 - protein, 261 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEE

SEQ ID NO: 45446 - protein, 31 aa, Homo sapiens
MRSGKASCTLETVWEDKHKYEEAERRFYEHE

SEQ ID NO: 45447 - protein, 68 aa, Homo sapiens
MRSGKASCTLETVWEDKHKYEEAERRFYEHEATQAAASAQQLPAEGPAMNGPGQDDPEDADEAEAPDG

SEQ ID NO: 45448 - protein, 262 aa, Homo sapiens
MATNFLAHEKIWFDKFKYDDAERRFYEQMNGPVAGASRQENGASVILRDIARARENIQKSLAGSSGPGASSGTSGDHVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 45449 - protein, 174 aa, Homo sapiens
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 45450 - protein, 139 aa, Homo sapiens
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIIRKLRHTEVGN

SEQ ID NO: 45451 - protein, 437 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 45452 - protein, 487 aa, Homo sapiens
MAERWVAPAVLRRARFASTFFLSPQIYAHKDGDLRSAFFILSFKRGEFIPFLNWTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 45453 - protein, 206 aa, Homo sapiens
MHHNKQATENAKEEVRRILGLLDAYLKTRTFLVGERVTLAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 45454 - protein, 858 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 45455 - protein, 583 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKETVSKKKKKKK

SEQ ID NO: 45456 - protein, 116 aa, Homo sapiens
MPKNKEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 45457 - protein, 144 aa, Homo sapiens
MPKNKGKGGKNRRRGKNENESEKRELVFKEDGQEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 45458 - protein, 144 aa, Homo sapiens
MPKNKGKGGKNRRRGKNENESEKRELVFKEDGQEYAQVIKMLGNGRLEALCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 45459 - protein, 127 aa, Homo sapiens
MPKNKGKGGKNRRRGKNENESEKRELVFKEDGQEYAQVIKMLGNGRLEALCFDGVKRLCHIRGKLRKKDNKADVILKYNADEARSLKAYGELPEHAKINETDTFGPGDDDEIQFDDIGDDDEDIDDI

SEQ ID NO: 45460 - protein, 472 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 45461 - protein, 183 aa, Homo sapiens
  MOD_RES (1)..(1): Any amino acid
XAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIGKYLTIGLDKSMWNKSKMKYLKGN

SEQ ID NO: 45462 - protein, 371 aa, Homo sapiens
MFQEVKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 45463 - protein, 585 aa, Homo sapiens
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 45464 - protein, 630 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 45465 - protein, 577 aa, Homo sapiens
MNQTHFVQDRCLSDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGFSVIPKPHPCKALYSAPQMISRQLRSLSCLCPALFPGTSSFIVALSSPANLYIPQRQRSDELVFESQKGSAMELAVITVDGV

SEQ ID NO: 45466 - protein, 1116 aa, Homo sapiens
MERAISPGLLVRALLLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 45467 - protein, 965 aa, Homo sapiens
MIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 45468 - protein, 522 aa, Homo sapiens
MAAVAVAVREDSGSGMKAELPPGPGAVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 45469 - protein, 543 aa, Homo sapiens
MPTQQPAAPSTRAPKPSRSLSGSLCALFSDADSGSGMKAELPPGPGAVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 45470 - protein, 305 aa, Homo sapiens
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 45471 - protein, 351 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEEDSFHKFVAPEEVLPFTEGDILEKVSVHCPVFDYVPPELITLFISNIGGNAPSYIYRLMSELYHPDDHVL

SEQ ID NO: 45472 - protein, 452 aa, Homo sapiens
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 45473 - protein, 197 aa, Homo sapiens
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKADGDSLCCQAGVQWHHLGSLQSPPPGFKHFTCLSLPSSWDYMHMPPH

SEQ ID NO: 45474 - protein, 412 aa, Homo sapiens
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGYVSPCTHLRQR

SEQ ID NO: 45475 - protein, 222 aa, Homo sapiens
  MOD_RES (1)..(1): Any amino acid
XVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEG

SEQ ID NO: 45476 - protein, 523 aa, Homo sapiens
MAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 45477 - protein, 520 aa, Homo sapiens
MAAVAVAVREDSGSGMKAESPWAWVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 45478 - protein, 721 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 45479 - protein, 337 aa, Homo sapiens
PPQPSKMLGLQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSL

SEQ ID NO: 45480 - protein, 857 aa, Homo sapiens
MEAGPSGAAAGAYLPPLQQVFQAPRRPGIGTVGKPIKLLANYFEVDIPKIDVYHYEVDIKPDKCPRRVNREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 45481 - protein, 782 aa, Homo sapiens
MVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 45482 - protein, 859 aa, Homo sapiens
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 45483 - protein, 825 aa, Homo sapiens
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 45484 - protein, 626 aa, Homo sapiens
MCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 45485 - protein, 229 aa, Homo sapiens
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDERDLWQQCGE

SEQ ID NO: 45486 - protein, 860 aa, Homo sapiens
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDVSATAFYKAQPVIQFMCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 45487 - protein, 229 aa, Homo sapiens; identical to SEQ ID NO: 45485

SEQ ID NO: 45488 - protein, 861 aa, Homo sapiens
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVKSNSMVGGPDPYLKEFGIVVHNEMTELTGRVLPAPMLQYGGRNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 45489 - protein, 584 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 45490 - protein, 271 aa, Homo sapiens [sequence omitted]

SEQ ID NO: 45491 - protein, 460 aa, Homo sapiens
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 45492 - protein, 271 aa, Homo sapiens [sequence omitted]

SEQ ID NO: 45493 - protein, 913 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 45494 - protein, 1382 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 45495 - protein, 1348 aa, Homo sapiens
MKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 45496 - protein, 872 aa, Homo sapiens
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPGIRSDLEHCAQPCVLWSRGRPAGSRVTPASSLCSLALDCDCAWILPLRHIFVPFSPWCLQWGI

SEQ ID NO: 45497 - protein, 814 aa, Homo sapiens
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 45498 - protein, 814 aa, Homo sapiens; identical to SEQ ID NO: 45497

SEQ ID NO: 45499 - protein, 738 aa, Homo sapiens
MQDAENVAVPEAAEERAGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 45500 - protein, 913 aa, Homo sapiens; identical to SEQ ID NO: 45493

SEQ ID NO: 45501 - protein, 761 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 45502 - protein, 913 aa, Homo sapiens; identical to SEQ ID NO: 45493

SEQ ID NO: 45503 - protein, 735 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 45504 - protein, 898 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 45505 - protein, 548 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 45506 - protein, 533 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 45507 - protein, 123 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILP

SEQ ID NO: 45508 - protein, 548 aa, Homo sapiens; identical to SEQ ID NO: 45505

SEQ ID NO: 45509 - protein, 172 aa, Homo sapiens
MDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRV

SEQ ID NO: 45510 - protein, 186 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQVMYLYQNSALEFGSVYLVVFINSLDEIYFTY

SEQ ID NO: 45511 - protein, 269 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVV

SEQ ID NO: 45512 - protein, 173 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEE

SEQ ID NO: 45513 - protein, 165 aa, Homo sapiens
MEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFAS

SEQ ID NO: 45514 - protein, 499 aa, Homo sapiens
MAKFMTPVIQDNPSGWGPCAVPEQFRDMPYQPFSKGDRLGKVADWTGATYQDKRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 45515 - protein, 445 aa, Homo sapiens
MAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 45516 - protein, 357 aa, Homo sapiens
MATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 45517 - protein, 208 aa, Homo sapiens
MEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 45518 - protein, 357 aa, Homo sapiens; identical to SEQ ID NO: 45516

SEQ ID NO: 45519 - protein, 372 aa, Homo sapiens
MNAVISASASFFLDKMATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 45520 - protein, 307 aa, Homo sapiens
MATPAVPVSAPPATPTPVPAAAPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 45521 - protein, 320 aa, Homo sapiens
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKELAEQLGLSTGEKEKLPGELEPVQATQNKTGKYVPPSLRDGASRRGESMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 45522 - protein, 366 aa, Homo sapiens
MYSRHAQRIPPGKKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 45523 - protein, 352 aa, Homo sapiens
MASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 45524 - protein, 125 aa, Homo sapiens
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFF

SEQ ID NO: 45525 - protein, 325 aa, Homo sapiens
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYMKIPCNDSKITSAVWGPLGECIIAGHESGELNQYSAKSGEVLVNVKEHSRQINDIQLSRDMTMFVTASKDNTAKLFDSTTLEHQKTFRTERPVNSAALSPNYDHVVLGGGQEAMDVTTTSTRIGKFEARFFHLAFEEEFGRVKGHFGPINSVAFHPDGKSYSSGGEDGYVRIHYFDPQYFEFEFEA

SEQ ID NO: 45526 - protein, 258 aa, Homo sapiens
MAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 45527 - protein, 218 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 45528 - protein, 124 aa, Homo sapiens
MIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSEW

SEQ ID NO: 45529 - protein, 211 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSEW

SEQ ID NO: 45530 - protein, 374 aa, Homo sapiens
MSVPAFIDISEEDQAAELRAYLKSKGAEISEENSEGGLHVDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 45531 - protein, 907 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 45532 - protein, 253 aa, Homo sapiens
MQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLFLCTSMTWKLLKKKLSWLGKKI

SEQ ID NO: 45533 - protein, 869 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 45534 - protein, 980 aa, Homo sapiens
MAGWPTPAGTRPWRTEARLCSDGEGAWLGPLAPWREARLASRRGGISFLLSPPLPTPSINIILLKILRCQAAKVESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 45535 - protein, 244 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQL

SEQ ID NO: 45536 - protein, 907 aa, Homo sapiens; identical to SEQ ID NO: 45531

SEQ ID NO: 45537 - protein, 907 aa, Homo sapiens; identical to SEQ ID NO: 45531

SEQ ID NO: 45538 - protein, 124 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALE

SEQ ID NO: 45539 - protein, 112 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILK

SEQ ID NO: 45540 - protein, 116 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVIL

SEQ ID NO: 45541 - protein, 444 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQISLRPAQSFLM

SEQ ID NO: 45542 - protein, 282 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMC

SEQ ID NO: 45543 - protein, 130 aa, Homo sapiens
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSS

SEQ ID NO: 45544 - protein, 406 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 45545 - protein, 146 aa, Homo sapiens
MEPEGVIESNWNEIVDSFDDMNLSESLLRGIYAYGFEKPSAIQQRAILPCIKGYDVIAQAQSGTGKTATFAISILQQIELDLKATQALVLAPTRELAQQVRVASIPSFRADLGMMSIIQGPEKSSLITTLGGRHGCPNTLETCWVN

SEQ ID NO: 45546 - protein, 200 aa, Homo sapiens
MFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMVCLPAASLLWVCPSEVSYLKPGFLEPRCLPGLLHICFLFQHGDMDQKERDVIMREFRSGSSRVLITTDLLVSRGN

SEQ ID NO: 45547 - protein, 341 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLNRSRWTVWP

SEQ ID NO: 45548 - protein, 407 aa, Homo sapiens
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 45549 - protein, 312 aa, Homo sapiens
MLTVLRSLPLFSRELLFPVLKIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 45550 - protein, 408 aa, Homo sapiens
MSGGSADYNSREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 45551 - protein, 57 aa, Homo sapiens
MSGGSADYNREHGGPEGMDPDGVIESNWNEIVDNFDDMNLKESLLRGIYAYGFEKPS

SEQ ID NO: 45552 - protein, 98 aa, Homo sapiens
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIE

SEQ ID NO: 45553 - protein, 120 aa, Homo sapiens
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 45554 - protein, 245 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 45555 - protein, 234 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKDNSSFRNTKITL

SEQ ID NO: 45556 - protein, 188 aa, Homo sapiens
MNNKFDALKDDDSGDHDQNEENSTQKDGEKEKTERDKNQSSSKRKVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKYVLGGYGRTCP

SEQ ID NO: 45557 - protein, 118 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 45558 - protein, 118 aa, Homo sapiens; identical to SEQ ID NO: 45557

SEQ ID NO: 45559 - protein, 118 aa, Homo sapiens; identical to SEQ ID NO: 45557

SEQ ID NO: 45560 - protein, 224 aa, Homo sapiens
MALPPAAAPPAGAREPPGSRAAAAAAAPEPPLGLQQLSALQPEPGGVPLHSSWTFWLDRSLPGATAAECASNLKKIYTVQTVQIFWSVYNNIPPVTSLPLRCSYHLMRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 45561 - protein, 118 aa, Homo sapiens; identical to SEQ ID NO: 45557

SEQ ID NO: 45562 - protein, 44 aa, Homo sapiens
MRGERRPLWEEESNAKGGVWKMKVPKDSTSTVWKELLLATIGEQ

SEQ ID NO: 45563 - protein, 51 aa, Homo sapiens
MRGERRPLWEEESNAKGGVWKMKVPKDSTSTVWKELLLATIGEQFTDCAAA

SEQ ID NO: 45564 - protein, 93 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLP

SEQ ID NO: 45565 - protein, 985 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 45566 - protein, 811 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 45567 - protein, 640 aa, Homo sapiens
MIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 45568 - protein, 63 aa, Homo sapiens
MDRRSMGETESGDAFLDLKKPPASKCPHRYTKEELLDIKELPHSKQRPSCLSEKYDSDGVWDP

SEQ ID NO: 45569 - protein, 63 aa, Homo sapiens; identical to SEQ ID NO: 45568

SEQ ID NO: 45570 - protein, 961 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 45571 - protein, 985 aa, Homo sapiens; identical to SEQ ID NO: 45565

SEQ ID NO: 45572 - protein, 436 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESLRLSPKKKKK

SEQ ID NO: 45573 - protein, 188 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERD

SEQ ID NO: 45574 - protein, 248 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 45575 - protein, 228 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 45576 - protein, 431 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRFCHNNKKAQRYLLHGLECVVAMHQAQLISKIPHILKEMYDADLLEEEVIISWSEKASKKYVSKELAKEIRVKAEPFIKWLKEAEEESSGGEEEDEDENIEVVYSKAASVPKVETVKSDNKDDDIDIDAI

SEQ ID NO: 45577 - protein, 431 aa, Homo sapiens; identical to SEQ ID NO: 45576

SEQ ID NO: 45578 - protein, 200 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEED

SEQ ID NO: 45579 - protein, 146 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPP

SEQ ID NO: 45580 - protein, 431 aa, Homo sapiens; identical to SEQ ID NO: 45576

SEQ ID NO: 45581 - protein, 69 aa, Homo sapiens
MSVNVNRSVSDQFYRYKMPRLIAKVEGKGNGIKTVIVNMVDVAKALNRPPTYPTKYFGCELGAQTQFDV

SEQ ID NO: 45582 - protein, 109 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDL

SEQ ID NO: 45583 - protein, 101 aa, Homo sapiens
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPE

SEQ ID NO: 45584 - protein, 51 aa, Homo sapiens
MSVNVNRSVSDQFYRYKMPRLIAKVEGKGNGIKTVIVNMVDVAKALNRPPT

SEQ ID NO: 45585 - protein, 109 aa, Homo sapiens; identical to SEQ ID NO: 45582

SEQ ID NO: 45586 - protein, 184 aa, Homo sapiens
MCGTGGTDSKTRRPPHRASFLKRLESKPLKMADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 45587 - protein, 154 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 45588 - protein, 214 aa, Homo sapiens
MTWTSRQEMQGPQPPSQCSAQHYVRMALWCSKAGHVRSSRCLLRRLASTATPRLEFHLRILPSPCLQYLWRSQQQAANSADFPLTLLLLSDCFCLALSLHTHSDNYTCSPVFSLFCGYPSVPASFSGSPSVSPALCQSLQFIGLYALAIQLLLPYSWFSLFLSSLEPLLSGCFHHVAQGFSNSTPSPGGTPASILSFQVTLLLRSPVLAFPLEL

SEQ ID NO: 45589 - protein, 154 aa, Homo sapiens; identical to SEQ ID NO: 45587

SEQ ID NO: 45590 - protein, 154 aa, Homo sapiens; identical to SEQ ID NO: 45587

SEQ ID NO: 45591 - protein, 153 aa, Homo sapiens
MADEIDFTTGDAGASSTYPMQCSALRKNGFVVLKGRPCKIVEMSTSKTGKHGHAKVHLVGIDIFTGKKYEDICPSTHNMDVPNIKRNDYQLICIQDGYLSLLTETGEVREDLKLPEGELGKEIEGKYNAGEDVQVSVMCAMSEEYAVAIKPCK

SEQ ID NO: 45592 - protein, 245 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 45593 - protein, 226 aa, Homo sapiens
MAVRASFENNCEIGCFAKLTNTYCLVAIGGSENFYRCGGSPGAYGGGEACAGVKSSGSGRVPAPLPRHHRVHVPTVCSRASSPIPSPWCTRLSPAAASSGACVWETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 45594 - protein, 245 aa, Homo sapiens; identical to SEQ ID NO: 45592

SEQ ID NO: 45595 - protein, 108 aa, Homo sapiens
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVT

SEQ ID NO: 45596 - protein, 437 aa, Homo sapiens
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 45597 - protein, 404 aa, Homo sapiens
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 45598 - protein, 423 aa, Homo sapiens
MKQDVLNCTEGPIHSNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 45599 - protein, 407 aa, Homo sapiens
MESRKDMVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEVSCTPDCATGNAEYQHSKGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 45600 - protein, 225 aa, Homo sapiens
MRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 45601 - protein, 476 aa, Homo sapiens
MMERIRKEMILMERGLHSPTAGKRFSNLSNSAGNAVLEALENSQHPARLSPRLPSAPLHSALGELPAKGKFEIDTLFNLQHTGSESTVSSEISSAAESRKKPGHYSEAAAEADMSSDVEVGCSALRSPGGLGAAQLKENNGKGYAESGSAAGTTTSASGSGLGSLHGGSGGSGGSAALGGSGSGADQVRRYRTAFTREQIARLEKEFYRENYVSRPRRCELAAALNLPETTIKVWFQNRRMKDKRQRLAMSWPHPADPSFYTYMMTHAAATGSLPYPFHSHVPLHYYPHVGVTAAAAAAAASGAAAAASSPFATSIRPLDTFRALSHPYSRPELLCSFRHPGLYQAPAAAAGLNSAASAAAAAAAAAAAASSAAAAGAPPSGGSAPCSCLSCHSSQSAAAAAAAAAAALGSRGGGGGGGGGGGGGGGGAGAGGGSDFGCSAAAPRSESGFLPYSAAVLSKTAVSPPDQRDEAPLTR

SEQ ID NO: 45602 - protein, 926 aa, Homo sapiens
MSRRRKHDDSPSPKKTPHKTVAAEECGSVVEPGRRRLRSARGSWPCGAREGPPGPVRQREQPPTAALCSKSNPEERYETPKRALKMDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAKNMFAISKQGSNLVQSKHLNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTKITQGVEKKKGVNPLLEEAVGQQSLVKLSESLKQSSKEEEEKNRKCSPEEIQRKRQEALVRRMAKARASSVNAAPTSFL

SEQ ID NO: 45603 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 45604 - protein, 718 aa, Homo sapiens
MPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 45605 - protein, 1250 aa, Homo sapiens
MEASRRFPEAEALSPEQAAHYLRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 45606 - protein, 894 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFATLPRKESAVKQETESLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 45607 - protein, 879 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFGLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 45608 - protein, 894 aa, Homo sapiens; identical to SEQ ID NO: 45606

SEQ ID NO: 45609 - protein, 745 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 45610 - protein, 640 aa, Homo sapiens
QCEDSTSFFTMKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 45611 - protein, 69 aa, Homo sapiens
MKETDREAVATAVQRVAGMLQRPDQLDKVEQYRRREARKKASVEARLKAAIQSQLDGVRTGLSQLHNAL

SEQ ID NO: 45612 - protein, 745 aa, Homo sapiens; identical to SEQ ID NO: 45609

SEQ ID NO: 45613 - protein, 677 aa, Homo sapiens
MDSAAKDEMQPALSPGSSFPGPEWPEQERAEQLARGAALKWASGIFYRPEQLARLGQYRSREVQRTCSLESRLKSVMQSYLEGVQTVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLVRASWAGRRARVSVAGWERGLARDPTPTCSGPGGERALRAGAARPEGAAKPPRPRAAGPGGGWPAATISRRERGPRLRPLGPARGLVPGAAPGRAQLPAGCAAAVAPREPPRPLQPSARARAPASCLPSGSCARALLLAE

SEQ ID NO: 45614 - protein, 746 aa, Homo sapiens
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQASVSQWLQNALDGEVAEWGREHGPNTDPSGSYYSPMPAIVLQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLGLEENAHCAPVLLALRELLNLRDPALLGLEVAGLRQQFPDVSEDHVSALLGLRGDLSREQHLAALSSLQAALPPSPRASRRVLFSLVPAPALAPASCLPSGSCARALLLAE

SEQ ID NO: 45615 - protein, 679 aa, Homo sapiens
MDSAAKDEMQPALSPGPEWPEQERAEQLARGAALKWASGIFYRPEQLARLGQYRSREVQRTCSLESRLKSVMQSYLEGVQTVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLVRASWAGRRARVSVAGWERGLARDPTPTCSGPGGERALRAGAARPEGAAKPPRPRAAGPGGGWPAATISRRERGPRLRPLGPARGLVPGAAPGRAQLPAGCAAAVAPREPPRPLQPSARARARAGLLPALGVLRPSPAARRINHGCR

SEQ ID NO: 45616 - protein, 974 aa, Homo sapiens [sequence omitted]

SEQ ID NO: 45617 - protein, 473 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQG

SEQ ID NO: 45618 - protein, 873 aa, Homo sapiens
MLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 45619 - protein, 262 aa, Homo sapiens
MHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 45620 - protein, 584 aa, Homo sapiens
MANLVTASKTKMSKGEDPNNPRSIKRISQGGRDNHLAIAKCDLTQLKKKQSEVSNGSRETISMKTCCQHGDRGYWSTGYYWRGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 45621 - protein, 593 aa, Homo sapiens
MADVWVKIQDVLQMLLTEYLDMKNTRTASEPSAQLSYASTGREFAAFFAKKKPQRPKNSLFKFESSSHAISMSAYLREQRRELYSRSGELQGGPDDNLIEGGGTKFVCKPGARNITVIFHPLLRFIQEIEHALGLGPAKQCPLREFLTVYIKNIFLNQVLAEINKEIEGVTKTSDPLKILANADTMKVLGVQRPLLQSTIIVEKTVQDLLNLMHDLSAYSDQFLNMVCVKLQEYKDTCTAAYRGIVQSEEKLVISASWAKDDDISRLLKSLPNWMNMAQPKQLRPKREEEEDFIRAAFGKESEVLIGNLGDKLIPPQDILRDVSDLKALANMHESLEWLASRTKSAFSNLSTSQMLSPAQDSHTNTDLPPVSEQIMQTLSELAKSFQDMADRCLLVLHLEVRVHCFHYLIPLAKEGNYAIVANVESMDYDPLVVKLNKDISAIEEAMSASLQQHKFQYIFEGLGHLISCILINGAQYFRRISESGIKKMCRNIFVLQQNLTNITMSREADLDFARQYYEMLYNTADELLNLVVDQGVKYTELEYIHALTLLHRSQTGVGELTTQNTRLQRLKEIICEQAAIKQATKDKKITTV

SEQ ID NO: 45622 - protein, 643 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 45623 - protein, 708 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 45624 - protein, 804 aa, Homo sapiens
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 45625 - protein, 153 aa, Homo sapiens
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKR

SEQ ID NO: 45626 - protein, 820 aa, Homo sapiens
MCCVGGAGSCSDTGKLGACRAMLEEETDQTYENVLAEIQSFELPVEATLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 45627 - protein, 799 aa, Homo sapiens
MLEEETDQTYENVLAEIQSFELPVEATLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 45628 - protein, 701 aa, Homo sapiens
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEGDEETFENYYRKQRKKQARLVLQPQSNMGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 45629 - protein, 72 aa, Homo sapiens
GKVAQTACMSACQHLSTSLMQMLLDSELKQISMGAVQQFNLDVIQCELFASSEPVPGFQGDTLQLAFIDLRQ

SEQ ID NO: 45630 - protein, 811 aa, Homo sapiens
MERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKMKDTSRKNNMFAQFRKNERDKQKLIDTVAKQLRGLISSHHS

SEQ ID NO: 45631 - protein, 671 aa, Homo sapiens
MERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPVSGSCYFVLYI

SEQ ID NO: 45632 - protein, 1989 aa, Homo sapiens
MTKVPPAFDFSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSNCDTDTTTDDEYYLDENDKESEL

SEQ ID NO: 45633 - protein, 1913 aa, Homo sapiens
MLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSNCDTDTTTDDEYYLDENDKESEL

SEQ ID NO: 45634 - protein, 819 aa, Homo sapiens
MPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSNCDTDTTTDDEYYLDENDKESEL

SEQ ID NO: 45635 - protein, 1801 aa, Homo sapiens
MREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSNCDTDTTTDDEYYLDENDKESEL

SEQ ID NO: 45636 - protein, 1982 aa, Homo sapiens
MSLSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSNCDTDTTTDDEYYLDENDKESEL

SEQ ID NO: 45637 - protein, 860 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 45638 - protein, 885 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 45639 - protein, 679 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAEVECRICFLPQEGKRQVTASASTPLTEACADSWQKATAGLHVLHASLLVSFNAEIGECSLWTSRLLPCPSGWLSNHPNQW

SEQ ID NO: 45640 - protein, 248 aa, Homo sapiens
MAAGFKTVEPLEYYRRFLKENCRPDGRELGEFRTTTVNIGSISTADGSALVKLGNTTVICGVKAFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 45641 - protein, 276 aa, Homo sapiens
MAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 45642 - protein, 439 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 45643 - protein, 456 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQELGFHHVGQTGLEFLTSDAPIILSDSEEEEMIILEPDKNPKKIRTQTTSAKQEKAPSKKPVKRRKKKRAAN

SEQ ID NO: 45644 - protein, 676 aa, Homo sapiens
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 45645 - protein, 330 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 45646 - protein, 330 aa, Homo sapiens; identical to SEQ ID NO: 45645

SEQ ID NO: 45647 - protein, 117 aa, Homo sapiens
MGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANR

SEQ ID NO: 45648 - protein, 266 aa, Homo sapiens
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGK

SEQ ID NO: 45649 - protein, 317 aa, Homo sapiens [sequence omitted]

SEQ ID NO: 45650 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 45651 - protein, 535 aa, Homo sapiens
MLHKSEEGRVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 45652 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 45653 - protein, 1071 aa, Homo sapiens; identical to SEQ ID NO: 45652

SEQ ID NO: 45654 - protein, 1071 aa, Homo sapiens; identical to SEQ ID NO: 45652

SEQ ID NO: 45655 - protein, 100 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCE

SEQ ID NO: 45656 - protein, 95 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILP

SEQ ID NO: 45657 - protein, 59 aa, Homo sapiens
MPAIMTMLADHAARQLLDFSQKLDINLLDNVVNCLYHGEGAQQRMAQEVLTHLKEHPDA

SEQ ID NO: 45658 - protein, 132 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNM

SEQ ID NO: 45659 - protein, 62 aa, Homo sapiens
MPAIMTMLADHAARQLLDFSQKLDINLLDNVVNCLYHGEGAQQRMAQEVLTHLKEHPDAWTR

SEQ ID NO: 45660 - protein, 179 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVF

SEQ ID NO: 45661 - protein, 94 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKIL

SEQ ID NO: 45662 - protein, 1204 aa, Homo sapiens
MAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 45663 - protein, 170 aa, Homo sapiens
MAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKPPHFPPLSAWKEIQVWSWREQALCRTRSNYTKVSRKGVRA

SEQ ID NO: 45664 - protein, 721 aa, Homo sapiens
MAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLHILSKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPFVADL

SEQ ID NO: 45665 - protein, 736 aa, Homo sapiens
MHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLHILSKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLVSIQSTDKRVSPRAEVD

SEQ ID NO: 45666 - protein, 832 aa, Homo sapiens
MTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 45667 - protein, 1125 aa, Homo sapiens
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 45668 - protein, 1111 aa, Homo sapiens
MTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 45669 - protein, 1087 aa, Homo sapiens
MADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 45670 - protein, 1088 aa, Homo sapiens
MRDPGRKSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 45671 - protein, 1096 aa, Homo sapiens
MADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQVSATAFLIEADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 45672 - protein, 2120 aa, Homo sapiens
MRSFKRVNFGTLLSSQKEAEELLPALKEFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKMQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLKTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVRGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 45673 - protein, 2120 aa, Homo sapiens; identical to SEQ ID NO: 45672

SEQ ID NO: 45674 - protein, 1795 aa, Homo sapiens
MEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKMQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLKTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVRGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 45675 - protein, 415 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 45676 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 45677 - protein, 567 aa, Homo sapiens
MGTTARAALVLTYLAVASAASEGGFTATGQRQLRPEHFQEVGYAAPPSPPLSRSLPMDHPDSSQHGPPFEGQSGKEGRGPRPHSQPWLGERVGCSHIPPSIVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 45678 - protein, 699 aa, Homo sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 45679 - protein, 164 aa, Homo sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATGTEI

SEQ ID NO: 45680 - protein, 160 aa, Homo sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSAT

SEQ ID NO: 45681 - protein, 643 aa, Homo sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRCVSDAVLETVTNRSDVAFPLW

SEQ ID NO: 45682 - protein, 592 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 45683 - protein, 559 aa, Homo sapiens
MLLFPQVAVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 45684 - protein, 592 aa, Homo sapiens; identical to SEQ ID NO: 45682

SEQ ID NO: 45685 - protein, 560 aa, Homo sapiens
MLMIYVQLVVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 45686 - protein, 557 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 45687 - protein, 508 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 45688 - protein, 538 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 45689 - protein, 459 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGKESCFERIMQRFGRKAVYVVIGDGVEEEQGAKKHNMPFWRISCHADLEALRHALELEYL

SEQ ID NO: 45690 - protein, 508 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRQNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 45691 - protein, 536 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQQLYFLDMEALGCQLEPTALILFIQLSGNLSNYNKL

SEQ ID NO: 45692 - protein, 416 aa, Homo sapiens
MIIPHKCILQTSSTNASLISTSSTIANIPAAAVASISNQDYPTYTILGQNQYQACYPSSSFGVTGQTNSDAESTTLAATTYQSEKPSVMAPAPAAQRLSSDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 45693 - protein, 573 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 45694 - protein, 447 aa, Homo sapiens
MKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 45695 - protein, 527 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 45696 - protein, 520 aa, Homo sapiens
MTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 45697 - protein, 639 aa, Homo sapiens
MEDSQDLNEQSVKKTCTESDVSQSQNSRSMEMQDLASPHTLVGGGDTPGSSKLEKSNLSSTSVTTNGTGGENMTVLNTADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIVSRFGTNITYVVIGDGRDEEHAANQHNMPFWRISSHSDLLALHQALELEYL

SEQ ID NO: 45698 - protein, 616 aa, Homo sapiens
MEDSQDLNEQSVKKTCTESDVSQSQNSRSMEMQDLASPHTLVGGGDTPGSSKLEKSNLSSTSVTTNGTGVSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 45699 - protein, 639 aa, Homo sapiens
MEDSQDLNEQSVKKTCTESDVSQSQNSRSMEMQDLASPHTLVGGGDTPGSSKLEKSNLSSTSVTTNGTGGENMTVLNTADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 45700 - protein, 3165 aa, Homo sapiens
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALILIVILEKPKPAERKVKKEALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 45701 - protein, 594 aa, Homo sapiens
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRYLCII

SEQ ID NO: 45702 - protein, 3165 aa, Homo sapiens; identical to SEQ ID NO: 45700

SEQ ID NO: 45703 - protein, 3144 aa, Homo sapiens
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 45704 - protein, 594 aa, Homo sapiens; identical to SEQ ID NO: 45701

SEQ ID NO: 45705 - protein, 619 aa, Homo sapiens
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRRILNTVIPHQIQQHIERFIQHDQVGFIVRI

SEQ ID NO: 45706 - protein, 587 aa, Homo sapiens
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 45707 - protein, 170 aa, Homo sapiens
MKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAASPLSLSWNSFYRTLSREQAIPENQIASPPSEAKGAEEPWMGPFPGQQG

SEQ ID NO: 45708 - protein, 490 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 45709 - protein, 128 aa, Homo sapiens
MLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 45710 - protein, 294 aa, Homo sapiens
MQPSSSTPPLHPYSTDGLIFPFNPQGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGRDLMEEGHYAQSHWWHPRSQ

SEQ ID NO: 45711 - protein, 446 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRG

SEQ ID NO: 45712 - protein, 456 aa, Homo sapiens
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRY

SEQ ID NO: 45713 - protein, 338 aa, Homo sapiens
MQPSSSTPPLHPYSTDGLIFPFNPQGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAASPLSLSWNSFYRTLSREQAIPENQIASPPSEAKGAEEPWMGPFPGQQG

SEQ ID NO: 45714 - protein, 486 aa, Homo sapiens
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 45715 - protein, 316 aa, Homo sapiens
MESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 45716 - protein, 472 aa, Homo sapiens
MAHTGRTVGRLGEGDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 45717 - protein, 684 aa, Homo sapiens
MGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLVSTESLWQHRVESRLLRDYAPTGRRLEDSSQQLGDQEPLGSPLAPGPLAQSVDSNKEEL

SEQ ID NO: 45718 - protein, 684 aa, Homo sapiens; identical to SEQ ID NO: 45717

SEQ ID NO: 45719 - protein, 684 aa, Homo sapiens; identical to SEQ ID NO: 45717

SEQ ID NO: 45720 - protein, 86 aa, Homo sapiens
MGLSAAAPLWGPPGLLLAIALHPALSVPPRRDYCVLGAGPAGLQMAYFLQRAGRDYAVFERAPRPGSFFTRYPRHRKLISINKRYT

SEQ ID NO: 45721 - protein, 242 aa, Homo sapiens
MFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 45722 - protein, 384 aa, Homo sapiens
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 45723 - protein, 144 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 45724 - protein, 144 aa, Homo sapiens; identical to SEQ ID NO: 45723

SEQ ID NO: 45725 - protein, 172 aa, Homo sapiens
MAQRLGEWARGPSDATGLYRAVLLRSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 45726 - protein, 135 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQVGDGHPAGTTHPPGLSSREELCCGHS

SEQ ID NO: 45727 - protein, 105 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQ

SEQ ID NO: 45728 - protein, 175 aa, Homo sapiens
MGAAQGKKKTYSPQARFHSENEKQRRNGSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 45729 - protein, 262 aa, Homo sapiens
MAPGSPPGPAIATMKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 45730 - protein, 249 aa, Homo sapiens
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 45731 - protein, 88 aa, Homo sapiens
MKLNERSLAFYATCDAPVDNAGFLYKKGGRHAAYHRRWFVLRGNMLFYFEDAASREPVGVIILVAVALWPRALSVSPWWLSQGSPDTP

SEQ ID NO: 45732 - protein, 282 aa, Homo sapiens
MQASCTRRVGGTRPTTGAGSCCAGTCSSTSRTLPAVSPWASSSWRAALWSWWRPPRSSPSLCALRGPGRAPTCWPLRVRMPWRAGSRPCRVPASTTCGWWCASWSSSWRLYVAGVAWPCPSPSPSPCPCPRPCPLPWPQSHPCLLPQPRSQPCPCPAGPVPSRPRRMAALSGALRPPSGLDPSPLHHRLAAGPRHPTGPWTWPPSPGCTSAMARRSGPCVASGSAAGSSPEATRAPVLGGHKLYALWDRPGPGETGGADPEGNHGQGWPPGPEWPGFGGCRL

SEQ ID NO: 45733 - protein, 117 aa, Homo sapiens
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLR

SEQ ID NO: 45734 - protein, 249 aa, Homo sapiens; identical to SEQ ID NO: 45730

SEQ ID NO: 45735 - protein, 249 aa, Homo sapiens; identical to SEQ ID NO: 45730

SEQ ID NO: 45736 - protein, 74 aa, Homo sapiens
MKLNERSLAFYATCDAPVDNAGFLYKKGGRHAAYHRRWFVLRGNMLFYFEDAASREPVGVIILEGCTVELVEAA

SEQ ID NO: 45737 - protein, 80 aa, Homo sapiens
MKLNERSLAFYATCDAPVDNAGFLYKKGGRHAAYHRRWFVLRGNMLFYFEDAASREPVGVIILEGCTVELVEAAEEFAFA

SEQ ID NO: 45738 - protein, 259 aa, Homo sapiens
MKLNERSVAHYALSDSPADHMGFLRTWGGPGTPPTPSGTGRRCWFVLKGNLLFSFESREGRAPLSLVVLEGCTVELAEAPVPEEFAFAICFDAPGVRPHLLAAEGPAAQEAWVKVLSRASFGYMRLVVRELESQLQDARQSLALQRRSSWKSVASRCKPQAPNHRAAGLENGHCLSKDSSPVGLVEEAGSRSAGWGLAEWELQGPASLLLGKGQSPVSPETSCFSTLHDWYGQEIVELRQCWQKRAQGSHSKCEEQDRP

SEQ ID NO: 45739 - protein, 108 aa, Homo sapiens
MKLNERSVAHYALSDSPADHMGFLRTWGGPGTPPTPSGTGRRCWFVLKGNLLFSFESREGRAPLSLVVLEGCTVELAEAPVPEEFAFAICFDAPGVRPHLLAAEGPAA

SEQ ID NO: 45740 - protein, 242 aa, Homo sapiens
MTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 45741 - protein, 910 aa, Homo sapiens
MGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 45742 - protein, 933 aa, Homo sapiens
MFGPRGSTSAGAGRKEILSRSSVMGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 45743 - protein, 922 aa, Homo sapiens
MDRQMILSRSSVMGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 45744 - protein, 1096 aa, Homo sapiens
MGVQGFQEFLEKRCPGAVVPVDLLKLARTVSRQQQQQHLHRQLPPTAALAPGAPRAARGSVPLQPPLPPAALGAYSGGAGPIRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKVFQSLEDHHLEVVAFFRENGFHGLLAHDSEYALYNIPSYYSSHALKLSWNGKNLTTNQFLMQEVAKQLGLKRMNFPIFAALLGNHILPDEDLAAFHWSLLGPEHPLASLKVRAHQLVLPPCDVVIKAVSEYVSSIKDPSNLDVVGKDVFKQSQSRTEDKIERFKKAVEYYSVTTKLSSLPVGPSFLGFRNNRLGNPPLPRNQVGTISAGKPMFSHQVPQKVKYPPPFPVGPNSSLLFSSHALGESHAFSEDPMLQNSPFANWAVSYDSSASQFPNYLPSKASPPLGPDSSHSSSSDGDEPNGASSDHITEAFHHQPEWGNPNRDRGSWAQPVDTGVSEASLGDGEPHIPSLLSMSTRNHMDITIPPLPPVAPEVLRVAEHRHRRGLMYPYIYHVLTKGEIKIPVCIEDECNMELPPAALLFRSARQYVYGVLFSLAETQRKMERLAMRRRLPVEVPSVILKEWSAYKGKSPQTPELVSALTFREWTCPNLKKLWLGKAVEDKNRRMRAFLACMKSDTPSMLNPANVPTHLLLMCCVLRYMVQWPGGRILHRHELDTFLAQAVSTQLYEPDRLQELKIEKLDARGIQLAALFMSGVDTALFANDACGQPVPWEHCCPWIYFDGKLFQSKLIKAGRERVSLVELCDGQADLATKVEKMRQSILEGVNMNHPPPSALLPSPTFVPPMVPSLYPVSLYSRAMGSMPLPPQGRSRGFAGLHPIPPQGGKLEIAGMVVGQWAGSRSSRGRGSFGMQVVSVGGPGKGHGKEQTGRGSKGHKKGNKQGSSDGVSKSLELHQGRSRSQVNGNSGALIKEEKSDHRLPAPSQCALSRDSNECNNGNRYLPMNNREKNHLQEQKLETVAQRKED

SEQ ID NO: 45745 - protein, 238 aa, Homo sapiens
MGVQGFQEFLEKRCPGAVVPVDLLKLARTVSRQQQQQHLHRQLPPTAALAPGAPRAARGSVPLQPPLPPAALGAYSGGAGPIRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKQAAML

SEQ ID NO: 45746 - protein, 1135 aa, Homo sapiens
METQKDEAAQAKGAAASGSTREQTAEKGAKNKAAEATEGPTSEPSSSGPGRLKKTAMKLFGGKKGICTLPSFFGGGRSKGSGKGSSKKGLSKSKTHDGLSEAAHGPEDVVSEGTGFSLPLPELPCQFPSSQSAHGALETGSRCKTSVAGATEKAVAEKFPSMPKPKKGLKGFFSSIRRHRKSKVTGAEQSEPGAKGPERVRARPHEHVSSAPQVPCFEETFQAPRKENANPQDAPGPKVSPTPEPSPPATEKMACKDPEKPMEACASAHVQPKPAPEASSLEEPHSPETGEKVVAGEVNPPNGPVGDPLSLLFGDVTSLKSFDSLTGCGDIIAEQDMDSMTDSMASGGQRANRDGTKRSSCLVTYQGGGEEMALPDDDDEEEEEEEEVELEEEEEEVKEEEEDDDLEYLWETAQMYPRPNMNLGYHPTTSPGHHGYMLLDPVRSYPGLAPGELLTPQSDQQESAPNSDEGYYDSTTPGFEDDSGEALGLVRRDCLPRDSYSGDALYEFYEPDDSLENSPPGDDCLYDLHGRSSEMFDPFLNFEPFLSSRPPGAMETEEERLVTIQKQLLYWELRREQLEAQEARAREAHAREAHAREAYTREAYGREAYAREAHTWEAHGREARTREAQAREVRCRETQVRETQARQEKPVLEYQMRPLGPSVMGLAAGVSGTSQISHRGITSAFPTTASSEPDWRDFRPLEKRYEGTCSKKDQSTCLMQLFQSDAMFEPDMQEANFGGSPRRAYPTYSPPEDPEEEEVEKEGNATVSFSQALVEFTSNGNLFSSMSCSSDSDSSFTQNLPELPPMVTFDIADVERDGEGKCEENPEFHNDEDLAASLEAFELGYYHKHAFNNYHSRFYQGLPWGVSSLPRYLGLPGLHPRPPPAAMALNRRSRSLDTAETLEMELSNSHLVQGYLESDELQAQQEDSDEEDEEEEEGEWSRDSPLSLYTEPPGAYDWPAWAPCPLPVGPGPAWISPNQLDRPSSQSPYRQATCCIPPMTMSISLSVPESRAPGESGPQLARPSHLHLPMGPCYNLQPQASQSMRARPRDVLLPVDEPSCSSSSGGFSPSPLPQAKPVGITHGIPQLPRVRPEHPQPQPTHYGPSSLDLSKERAEQGASLATSYSSTAMNGNLAK

SEQ ID NO: 45747 - protein, 804 aa, Homo sapiens
METQKDEAAQAKGAAASGSTREQTAEKGAKNKAAEATEGPTSEPSSSGPGRLKKTAMKLFGGKKGICTLPSFFGGGRSKGSGKGSSKKGLSKSKTHDGLSEAAHGPEDVVSEGTGFSLPLPELPCQFPSSQSAHGALETGSRCKTSVAGATEKAVAEKFPSMPKPKKGLKGFFSSIRRHRKSKVTGAEQSEPGAKGPERVRARPHEHVSSAPQVPCFEETFQAPRKENANPQDAPGPKVSPTPEPSPPATEKMACKDPEKPMEACASAHVQPKPAPEASSLEEPHSPETGEKVVAGEVNPPNGPVGDPLSLLFGDVTSLKSFDSLTGCGDIIAEQDMDSMTDSMASGGQRANRDGTKRSSCLVTYQGGGEEMALPDDDDEEEEEEEEVELEEEEEEVKEEEEDDDLEYLWETAQMYPRPNMNLGYHPTTSPGHHGYMLLDPVRSYPGLAPGELLTPQSDQQESAPNSDEGYYDSTTPGFEDDSGEALGLVRRDCLPRDSYSGDALYEFYEPDDSLENSPPGDDCLYDLHGRSSEMFDPFLNFEPFLSSRPPGAMETEEERLVTIQKQLLYWELRREQLEAQEARAREAHAREAHAREAYTREAYGREAYAREAHTWEAHGREARTREAQAREVRCRETQVRETQARQEKPVLEYQMRPLGPSVMGLAAGVSGTSQISHRGITSAFPTTASSEPDWRDFRPLEKRYEGTCSKKDQSTCLMQLFQSDAMFEPDMQEANFGGSPRRAYPTYSPPEDPEEEEVEKEGNATVSFSQALVEFTSNGNLFSSIRCPGTEDKRQVTQACGTW

SEQ ID NO: 45748 - protein, 521 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 45749 - protein, 113 aa, Homo sapiens
MDGRVQLIKALLALPIRPATRRWRNPIPFPETFDGDTDRLPEFIVQTGSYMFVDENTFSSDALKVTFLITRLTGPALQWVIPYIKKESPLLNDYRGFLAEMKRVFGWEEDEDF

SEQ ID NO: 45750 - protein, 746 aa, Homo sapiens
MGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 45751 - protein, 733 aa, Homo sapiens
MGWMGEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 45752 - protein, 396 aa, Homo sapiens [sequence omitted]

SEQ ID NO: 45753 - protein, 1023 aa, Homo sapiens
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFHVPPGLEGMKEQDLCNKIMAKILENYNTLFEVEYTENDHLRCENLARLIIVKEVYYKNSLPILLTRGLERDMPKPPPKTKIPKSRSEGSIQAHRVLQPELSDGIPQLSLRLSYRKACLEDMNSAEGAISAKLVPSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 45754 - protein, 669 aa, Homo sapiens
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 45755 - protein, 697 aa, Homo sapiens
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 45756 - protein, 202 aa, Homo sapiens
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFQ

SEQ ID NO: 45757 - protein, 497 aa, Homo sapiens
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 45758 - protein, 356 aa, Homo sapiens
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 45759 - protein, 716 aa, Homo sapiens
MATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRRSLEEKKMLEEERNRILTKQKQRMKELQKLLTTRAKAYDSHQSLAQISKSRVKCLRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 45760 - protein, 660 aa, Homo sapiens
MATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 45761 - protein, 214 aa, Homo sapiens
MSVPQIHVEEVGAEEGAGAAAPPDDHLRSLKALTEKLRLETRRPSYLEWQARLEEHTWPFPRPAAEPQASLEEGERGGQEPLLPLREAGQHPPSARSASQGARPLSTGKLEGFQSIDEAIAWLRKELTEMRLQDQQLARQLMRLRGDINKLKIEHTCRLHRRMLNDATYELEERDELADLFCDSPLASSFSLSTPLKLIGVTKMNINSRRFSLC

SEQ ID NO: 45762 - protein, 415 aa, Homo sapiens
MAASISGYTFSAVCFHSANSNADHEGFLLGEVRQEETFSISDSQISNTEFLQVIEIHNHQPCSKLFSFYDYASKVNEESLDRILKDRRKKVIGWYRFRRNTQQQMSYREQVLHKQLTRILGVPDLVFLLFSFISTANNSTHALEYVLFRPNRRYNQRISLAIPNLGNTSQQEYKVSSVPNTSQSYAKVIKEHGTDFFDKDGVMKDIRAIYQVYNALQEKVQAVCADVEKSERVVESCQAEVNKLRRQITQRKNEKEQERRLQQAVLSRQMPSESLDPAFSPRMPSSGFAAEGRSTLGDAEASDPPPPYSDFHPNNQESTLSHSRMERSVFMPRPQAVGSSNYASTSAGLKYPGSGADLPPPQRAAGDSGEDSDDSDYENLIDPTEPSNSEYSHSKDSRPMAHPDEDPRNTQTSQI

SEQ ID NO: 45763 - protein, 1173 aa, Homo sapiens
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQGQLHDFWVPDS

SEQ ID NO: 45764 - protein, 1186 aa, Homo sapiens
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQVSFCYTISCILNSFAEWHSSYCLK

SEQ ID NO: 45765 - protein, 758 aa, Homo sapiens
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRFVSIKINLLNLTFCLFVWLTFNLPFLKNHEKLACILDSVVNCVRIRYVGRTQWLMPVITTLWETQARLLEPRSSRLR

SEQ ID NO: 45766 - protein, 224 aa, Homo sapiens
MTRITELWSSPQWKVGAEVCGRQMREQRTAEQSETQRTWLSMAATLQFLVCLVVAICLLSGVTTTQPHAGQPMDSTSVGGGLQEPEAPEVMFELLWAGLELDVMGQLHIQDEELASTHPGRRLRLLLQHHVPSDLEGTEQWLQQLQDLRKGPPLSTWDFEHLLLTGLSCVYRLHAASEAEERGRWAQVFALLAQETLWDLCKGFCPQDRPPSLGSWASILDPFP

SEQ ID NO: 45767 - protein, 201 aa, Homo sapiens
MREQRTAEQSETQRTWLSMAATLQFLVCLVVAICLLSGVTTTQPHAGQPMDSTSVGGGLQEPEAPEVMFELLWAGLELDVMGQLHIQDEELASTHPGRRLRLLLQHHVPSDLEGTEQWLQQLQDLRKGPPLSTWDFEHLLLTGLSCVYRLHAASEAEERGRWAQVFALLAQETLWDLCKGFCPQDRPPSLGSWASILDPFP

SEQ ID NO: 45768 - protein, 541 aa, Homo sapiens
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 45769 - protein, 541 aa, Homo sapiens; identical to SEQ ID NO: 45768

SEQ ID NO: 45770 - protein, 145 aa, Homo sapiens
MFTSPSEGKPGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 45771 - protein, 409 aa, Homo sapiens
MKLKQRVVLLAILLVIFIFTKVFLIDNLDTSAANREDQRAFHRMMTGLRVELAPKLDHTLQSPWEIAAQWVVPREVYPEETPELGAVMHAMATKKIIKADVGYKGTQLKALLILEGGQKVVFKPKRYSRDHVVEGEPYAGYDRHNAEVAAFHLDRILGFHRAPLVVGRFVNLRTEIKPVATEQLLSTFLTVGNNTCFYGKCYYCRETEPACADGDIMEGSVTLWLPDVWPLQKHRHPWGRTYREGKLARWEYDESYCDAVKKTSPYDSGPRLLDIIDTAVFDYLIGNADRHHYESFQDDEGASMLILLDNAKSFGNPSLDERSILAPLYQCCIIRVSTWNRLNYLKNGVLKSALKSAMAHDPISPVLSDPHLDAVDQRLLSVLATVKQCTDQFGMDTVLVEDRMPLSHL

SEQ ID NO: 45772 - protein, 138 aa, Homo sapiens
MKLKQRVVLLAILLVIFIFTKVFLIDNLDTSAANREDQRAFHRMMTGLRVELAPKLDHTLQSPWEIAAQWVVPREVYPEETPELGAVMHAMATKKIIKADVGYKGTQLKALLILEGGQKVVFKPKRYSRDHVVEGEPY

SEQ ID NO: 45773 - protein, 584 aa, Homo sapiens
MKMMLVRRFRVLILMVFLVACALHIALDLLPRLERRGARPSGEPGCSCAQPAAEVAAPGWAQVRGRPGEPPAASSAAGDAGWPNKHTLRILQDFSSDPSSNLSSHSLEKLPPAAEPAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 45774 - protein, 1318 aa, Homo sapiens
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45775 - protein, 1262 aa, Homo sapiens
MNRTTPDQELVPASEPVWERPWSVEEIRRSSQSWSLAADAGRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45776 - protein, 132 aa, Homo sapiens
MEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQVRNPL

SEQ ID NO: 45777 - protein, 1320 aa, Homo sapiens
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45778 - protein, 1341 aa, Homo sapiens [sequence omitted]

SEQ ID NO: 45779 - protein, 279 aa, Homo sapiens
MMNRTTPDQELVPASEPVWERPWSVEEIRRSSQSWSLAADAGRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSD

SEQ ID NO: 45780 - protein, 1253 aa, Homo sapiens
MPRLSGKSVRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTGKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45781 - protein, 1245 aa, Homo sapiens
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTNEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLVQEKKRVVKKDHSVNSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45782 - protein, 1279 aa, Homo sapiens
MMNRTTPDQELVPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFTEASQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKVTLSYSKNLKPSSETKTQKGLFSDEEDSEDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGCDPDAHPKSTGVFQDEELLFSHKLQKDNDPDVDLFAGTKKTKLLEPSVGSLFGDDEDDDLFSSAKSQPLANLAINPAALLPTAASQISEVKPVLPELAFPSSEHRRSHGLESVPVLPGSGEAGVSFDLPAQADTLHSANKSRVKMRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 45783 - protein, 442 aa, Homo sapiens
MAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 45784 - protein, 391 aa, Homo sapiens
MAEESSCTRDCMSFSVLNWDQVSRLHEVLTEVVPIHGRGNFPTLEITLKDIVQTVRSRLEEAGIKVHDVRLNGSAAGHVLVKDNGLGCKDLDLIFHVALPTEAEFQLVRDVVLCSLLNFLPEGVNKLKISPVTLKEAYVQKLVKVCTDTDRWSLISLSNKNGKNVELKFVDSIRRQFEFSVDSFQIILDSLLFFYDCSNNPISEHFHPTVIGESMYGDFEEAFDHLQNRLIATKNPEEIRGGGLLKYSNLLVRDFRPTDQEEIKTLERYMCSRFFIDFPDILEQQRKLETYLQNHFAEEERSKYDYLMILRRVVNESTVCLMGHERRQTLNLISLLALRVLAEQNIIPSATNVTCYYQPAPYVSDGNFSNYYVAHPPVTYSQPYPTWLPCN

SEQ ID NO: 45785 - protein, 779 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAVLSQLGSAENRPEQSLPQQRFQLSSAFQQQQQQIQQLRFLQHQMAMAAAAAQTAQLHHHRHTGSQSKSKMKRGTPTTPKF

SEQ ID NO: 45786 - protein, 733 aa, Homo sapiens
MQQALELALDRAEYVIESARQRPPKRKYLSSGRKSVFQKLYDLYIEECEKEPEVKQKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 45787 - protein, 733 aa, Homo sapiens; identical to SEQ ID NO: 45786

SEQ ID NO: 45788 - protein, 733 aa, Homo sapiens; identical to SEQ ID NO: 45786

SEQ ID NO: 45789 - protein, 738 aa, Homo sapiens
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPDTRALNQKN

SEQ ID NO: 45790 - protein, 498 aa, Homo sapiens
MYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRHES

SEQ ID NO: 45791 - protein, 225 aa, Homo sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 45792 - protein, 257 aa, Homo sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 45793 - protein, 330 aa, Homo sapiens
MISTRYRRRRDAPRGPGRCPPHPTRPRGPGRKRGAAGSPGAAPSASRRPEFPKPLRVLPWRERGRGGREWPMSLRSPLPTSACGWGESGRRPGRAPCGPRTGLSARAVLSARARLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 45794 - protein, 246 aa, Homo sapiens [sequence omitted]

SEQ ID NO: 45795 - protein, 194 aa, Homo sapiens
MEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQIYTMDTEIP

SEQ ID NO: 45796 - protein, 226 aa, Homo sapiens
MEAPEAAEGGLQRGARRAAGARSQGALPSGEVHHGGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQIYTMDTEIP

SEQ ID NO: 45797 - protein, 214 aa, Homo sapiens
MEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 45798 - protein, 246 aa, Homo sapiens
MEAPEGGGGPAARGPEGPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 45799 - protein, 142 aa, Homo sapiens
MEAGVKLGMRSIPIATACTIYHKFFCETNLDAYDPYLIAMSSIYLAGKVEEQHLRTRDIINVSNRFIPWTQRSPKVLAQACPKRSPGWSAAWGHCHHVAMTAGPHRTSWEDWLCCWRRAGEGNGMLPLCQSLEVAVQVMVGA

SEQ ID NO: 45800 - protein, 94 aa, Homo sapiens
  MOD_RES (1)..(1): Any amino acid
XAGKVEEQHLRTRDIINVSNRYFNPSGEPLELDSRFWELRDSIVQCELLMLRVLRFQVSFQHPHKVFNDDLTKPIIDNIVSDLIQIYTMDTEIP

SEQ ID NO: 45801 - protein, 121 aa, Homo sapiens
  MOD_RES (1)..(1): Any amino acid
XRYFNPSGEPLELDSRFWELRDSIVQCELLMLRVLRFQVSFQHPHKNWLNRHSWQRTPVAVTAWALLRDSYHGALCLRFQAQHIAVAVLYLALQVYGVEVPAEVEAEKPWWQIYTMDTEIP

SEQ ID NO: 45802 - protein, 1068 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFRWLHPSPDKPRRLSVLSALQDTFFAKLHRSRSFSDLPSLRPSPKAVLELYSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 45803 - protein, 591 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKK

SEQ ID NO: 45804 - protein, 647 aa, Homo sapiens
MVLPSRLHWIRNRPWRDRIRRRQLNRLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKDAKHLDDQKLNGAASWTEITEGE

SEQ ID NO: 45805 - protein, 1047 aa, Homo sapiens
MQFFDAEELLVDEEDDVFGEGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 45806 - protein, 613 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKDAKHLDDQKLNGAASWTEITEGE

SEQ ID NO: 45807 - protein, 573 aa, Homo sapiens
MGKCLSCCKEDQSFQRCSPEDQVSTDAQHRGASSISQPSISLGHKTSYSPVTHKVNAAKASRRLLSVSSPSFSERRYSLFVGFQKRNASPYWQQSRANFDSEEDTGFTDIKSSSDHCGSFISRRRRFSSRKLSIVSYYKSAIFFDPQASGQNVFNLNEIEIFSKTSSNTDAKKHITISAPEYNTKNFKNFETNTTSPAFGNTIDTASYQQSTSSFFSLASDISSPDQQNGIANDIQQRGQLCKDLKDFLHPRPESYSTGHSPIMIPQHPSQSGTFPFLHKAGFSSSYKNSGCFIPPQSELTSGLFEDEDFAVLFQDEDRSSPIEIPKIRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEEL

SEQ ID NO: 45808 - protein, 410 aa, Homo sapiens
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 45809 - protein, 410 aa, Homo sapiens; identical to SEQ ID NO: 45808

SEQ ID NO: 45810 - protein, 175 aa, Homo sapiens
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVE

SEQ ID NO: 45811 - protein, 265 aa, Homo sapiens
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 45812 - protein, 150 aa, Homo sapiens
  MOD_RES (1)..(1): Any amino acid
XVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKRLRKTK

SEQ ID NO: 45813 - protein, 238 aa, Homo sapiens
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNL

SEQ ID NO: 45814 - protein, 470 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 45815 - protein, 470 aa, Homo sapiens; identical to SEQ ID NO: 45814

SEQ ID NO: 45816 - protein, 407 aa, Homo sapiens [sequence omitted]

SEQ ID NO: 45817 - protein, 287 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDM

SEQ ID NO: 45818 - protein, 314 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 45819 - protein, 284 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 45820 - protein, 1179 aa, Homo sapiens
MARRSQSSSQGDNPLAPGYLPPHYKEYYRLAVDALAEGGSEAYSRFLATEGAPDFLCPEELEHVSRHLRPPQYVTREPPEGSLLDVDMDGSSGTYWPVNSDQAVPELDLGWPLTFGFQGTEVTTLVQPPPPDSPSIKDEARRMIRSAQQVVAVVMDMFTDVDLLSEVLEAAARRVPVYILLDEMNAQHFLDMADKCRVNLQHVDFLRVRTVAGPTYYCRTGKSFKGHVKEKFLLVDCAVVMSGSYSFMWSFEKIHRSLAHVFQGELVSSFDEEFRILFAQSEPLVPSAAALARMDAYALAPYAGAGPLVGVPGVGAPTPFSFPKRAHLLFPPPREEGLGFPSFLDPDRHFLSAFRREEPPRMPGGALEPHAGLRPLSRRLEAEAGPAGELAGARGFFQARHLEMDAFKRHSFATEGAGAVENFAAARQVSRQTFLSHGDDFRFQTSHFHRDQLYQQQYQWDPQLTPARPQGLFEKLRGGRAGFADPDDFTLGAGPRFPELGPDGHQRLDYVPSSASREVRHGSDPAFAPGPRGLEPSGAPRPNLTQRFPCQAAARPGPDPAPEAEPERRGGPEGRAGLRRWRLASYLSGCHGEDGGDDGLPAPMEAEAYEDDVLAPGGRAPAGDLLPSAFRVPAAFPTKVPVPGPGSGGNGPEREGPEEPGLAKQDSFRSRLNPLVQRSSRLRSSLIFSTSQAEGAAGAAAATEKVQLLHKEQTVSETLGPGGEAVRSAASTKVAELLEKYKGPARDPGGGAGAITVASHSKAVVSQAWREEVAAPGAVGGERRSLESCLLDLRDSFAQQLHQEAERQPGAASLTAAQLLDTLGRSGSDRLPSRFLSAQSHSTSPQGLDSPLPLEGSGAHQVLHNESKGSPTSAYPERKGSPTPGFSTRRGSPTTGFIEQKGSPTSAYPERRGSPVPPVPERRSSPVPPVPERRGSLTLTISGESPKAGPAEEGPSGPMEVLRKGSLRLRQLLSPKGERRMEDEGGFPVPQENGQPESPRRLSLGQGDSTEAATEERGPRARLSSATANALYSSNLRDDTKAILEQISAHGQKHRAVPAPSPGPTHNSPELGRPPAAGVLAPDMSDKDKCSAIFRSDSLGTQGRLSRTLPASAEERDRLLRRMESMRKEKRVYSRFEVFCKKEEASSPGAGEGPAEEGTRDSKVGKFVPKILGTFKSKK

SEQ ID NO: 45821 - protein, 310 aa, Homo sapiens
MGNQVEKLTHLSYKEVPTADPTGVDRDDGPRIGVSYIFSNDDEDVEPQPPPQGPDGGGLPDGGDGPPPPQPQPYDPRLHEVECSVFYRDECIYQKSFAPGSAALSTYTPENLLNKCKPGDLVEFVSQAQYPHWAVYVGNFQVVHLHRLEVINSFLTDASQGRRGRVVNDLYRYKPLSSSAVVRNALAHVGAKERELSWRNSESFAAWCRYGKREFKIGGELRIGKQPYRLQIQLSAQRSHTLEFQSLEDLIMEKRRNDQIGRAAVLQELATHLHPAEPEEGDSNVARTTPPPGRPPAPSSEEEDGEAVAH

SEQ ID NO: 45822 - protein, 332 aa, Homo sapiens
MEPVGRKRSRKAAKAQLEAQVTAAQGATKEGSGIASNFPGQPTMEPVGRKRSRKAAKAQLEAQVRAAPAKKHTGKDPVRDECEERNPFTETREEDVTDEHGEREPFAEKDEHTGIHTMKLEHIAADIKKGLAAKREMIKIDKAAYRKTKNTIERALKKKQLKRQKRDYRHTRKLLNVLKEYIAEKQKDDEAEEAEAAAAAAEAAAAAEAAAAAAEVIVVEDEEEEEKEEEEEKEEEEEEGEEEGGGEEGEEGGGGGEGEETEEEEEEEEEEEEEEQIKAFQEKQKRWQQPTGVRSWRLREMKPLLEQLLKAAKDTKDNYCIISSSEESELDN

SEQ ID NO: 45823 - protein, 332 aa, Homo sapiens; identical to SEQ ID NO: 45822

SEQ ID NO: 45824 - protein, 186 aa, Homo sapiens
MAAWGKKHAGKDPVRDECEERNRFTETREEDVTDEHGEREPFAETDEHTGANTKKPEDTAEDLTAKRKRMKMDKTCSKTKNKSKHALRKKQLKRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 45825 - protein, 226 aa, Homo sapiens
MPGFLSFLSVSLRSPGSGIASSFPGQPATDPVGRRAAKAQLEAQFMAAWGKKHAGKDPVRDECEERNRFTETREEDVTDEHGEREPFAETDEHTGANTKKPEDTAVGANNFKNYPVHIGVSSEQHILLDCSLSRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 45826 - protein, 186 aa, Homo sapiens; identical to SEQ ID NO: 45824

SEQ ID NO: 45827 - protein, 166 aa, Homo sapiens
MAAKDQLEVQVMAAQEMELAGKDPVSHEHEERKPVTETKEGDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 45828 - protein, 166 aa, Homo sapiens; identical to SEQ ID NO: 45827

SEQ ID NO: 45829 - protein, 126 aa, Homo sapiens
  MOD_RES (1)..(1): Any amino acid
XDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 45830 - protein, 128 aa, Homo sapiens
MAAKDQLEVQVMAAQEMELAGKDPVSHEHEERKPVTETKEGDVTDEHGERGSFAETDEHTGVDTKELEDIAGMFYELFVVYENCFQPYNPYSRLYELVDDKTVLNAFFSYIAFNVICLIIFLTYFFNC

SEQ ID NO: 45831 - protein, 464 aa, Homo sapiens
MMARRDPKPGAKRLVRAQTLQKQRRAPVGPRAPPPDEEDPRLKCKNCEAFGHTARSTRCPMKCWKAALVPPNFGEKEGKENLKPWKPQVEANPGPLNKDKGEKEERPRPQDPQRKALLHIFSRKPPEKPLPNQKGSTESSDYLRVASGPMPVHTTSKRPRVDPVLSDRSATEMSDRGSVLASLSPLRKASLSSSSSLGPKERQTGAAADIPQTAVRHQGPEPLLVVKPTHSSPAGGCREVPQAASKTHGLLQAVSPQAQDKRPAVTSQPCPPAATHSLGLGSNLSFGPGAKRSAPAPIQACLNFPKKPRLGPFQIPESAIQGGELGAPENLQPPPAATELGPRTSPQTGTRTPAQVLSGDRQPPHSRPCLPTAQACTMSHHPAASHDGAQPLRVLFRRLENGRWSSSLLTAPSFHSPEKPGAFLAQSPHVSEKSEGPCVRVPPSVLYEDLQVPSSSEDSDSDLE

SEQ ID NO: 45832 - protein, 14 aa, Homo sapiens
MMARRDPKPGAKRL

SEQ ID NO: 45833 - protein, 464 aa, Homo sapiens; identical to SEQ ID NO: 45831

SEQ ID NO: 45834 - protein, 380 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQVNSPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 45835 - protein, 859 aa, Homo sapiens
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQREKKKMLQTNLKVSGALYREITLKVAEVQLKSDFAAQKLSNL

SEQ ID NO: 45836 - protein, 859 aa, Homo sapiens; identical to SEQ ID NO: 45835

SEQ ID NO: 45837 - protein, 818 aa, Homo sapiens
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQR

SEQ ID NO: 45838 - protein, 558 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMVQVKAVLGHLLAMSRSSSLSAQDLQTVAGQGTDTDLRAPAQQLIRHLLLNFLLWAPGGHTIAWDVITLMAHTAEITHEIIGFLDQTLYRWNRLGIESPRSEKLARELLKELRTQV

SEQ ID NO: 45839 - protein, 558 aa, Homo sapiens; identical to SEQ ID NO: 45838

SEQ ID NO: 45840 - protein, 150 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLL

SEQ ID NO: 45841 - protein, 1471 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEVSLQNPPESGTDGCILLIVLSWWSRTLPTYVYCQMLLCPFPFPP

SEQ ID NO: 45842 - protein, 1249 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRFMKRNSSTGTWLFETSVSSST

SEQ ID NO: 45843 - protein, 1451 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 45844 - protein, 1451 aa, Homo sapiens; identical to SEQ ID NO: 45843

SEQ ID NO: 45845 - protein, 536 aa, Homo sapiens
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 45846 - protein, 374 aa, Homo sapiens
MESLLQHLDRFSELLAVSSTTYVSTWDPATVRRALQWARYLRHIHRRFGRHGPIRTALERRLHNQWRQEGGFGRGPVPGLANFQALGHCDVLLSLRLLENRALGDAARYHLVQQLFPGPGVRDADEETLQESLARLARRRSAVHMLRFNGYRENPNLQEDSLMKTQAELLLERLQEVGKAEAERPARFLSSLWERLPQNNFLKVIAVALLQPPLSRRPQEELEPGIHKSPGEGSQVLVHWLLGNSEVFAAFCRALPAGLLTLVTSRHPALSPVYLGLLTDWGQRLHYDLQKGIWVGTESQDVPWEELHNRFQSLCQAPPPLKDKVLTALETCKAQDGDFEVPGLSIWTDLLLALRSGAFRKRQVLGLSAGLSSV

SEQ ID NO: 45847 - protein, 1268 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 45848 - protein, 1328 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 45849 - protein, 1095 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSVSPGVSELRRNSKKYGKAGEAVWFSSDPPVLFFHFLRTE

SEQ ID NO: 45850 - protein, 73 aa, Homo sapiens
MFKDVPLTAEEVEFVVEKALSMFSKMNLQEIPPLVYQLLVLSSKGSRKSVLEGIIAFFSALDKQHNEEQSGDE

SEQ ID NO: 45851 - protein, 375 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 45852 - protein, 127 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKAP

SEQ ID NO: 45853 - protein, 2048 aa, Homo sapiens
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGMRQSSLKKDWFLSEEEFKLWNRLYRLRDSDEIKEITLPQVQFSSLQNEENKPAQESTTGIHQLSLSEWRLWQDHPLPTHQVDHSDRCRHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQLKKENNHGIIDSVDNDRNSTVENIFQEDLPNDKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 45854 - protein, 669 aa, Homo sapiens
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGK

SEQ ID NO: 45855 - protein, 655 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGFANHARSHHHLY

SEQ ID NO: 45856 - protein, 644 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 45857 - protein, 654 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQEGDQQNPAPAGQVDYTKAWEEYYKKMGQAVPAPTGAPPGGQPDYSAAWAEYYRQQAAYYAQTSPQGMPQHPPAPQCRFDPASIELAL

SEQ ID NO: 45858 - protein, 629 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 45859 - protein, 232 aa, Homo sapiens
MADYSTVPPPSSGSAGGGGGGGGGGGVNDAFKDALQRARQIAAKIGGDAGTSLNSNDYGYGGQKRPLEDGDGSWTSPSSTTHWEGMPSPFKDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQ

SEQ ID NO: 45860 - protein, 665 aa, Homo sapiens
MADYSTVPPPSSGSAGGGGGGGGGGGVNDAFKDALQRARQIAAKIGGDAGTSLNSNDYGYGGQKRPLEDGDGSWTSPSSTTHWEGMPSPFKDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 45861 - protein, 419 aa, Homo sapiens
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 45862 - protein, 419 aa, Homo sapiens; identical to SEQ ID NO: 45861

SEQ ID NO: 45863 - protein, 353 aa, Homo sapiens
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 45864 - protein, 417 aa, Homo sapiens
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45865 - protein, 374 aa, Homo sapiens
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45866 - protein, 332 aa, Homo sapiens
MTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45867 - protein, 410 aa, Homo sapiens
MEFVKCLGHPEEFYNLVRFRIGGKRKDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45868 - protein, 332 aa, Homo sapiens; identical to SEQ ID NO: 45866

SEQ ID NO: 45869 - protein, 353 aa, Homo sapiens
MRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45870 - protein, 353 aa, Homo sapiens; identical to SEQ ID NO: 45869

SEQ ID NO: 45871 - protein, 306 aa, Homo sapiens
MESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 45872 - protein, 379 aa, Homo sapiens
MAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 45873 - protein, 312 aa, Homo sapiens
MAATEGVGEAAQGGEPGQPAQPPPQPHPPPPQQQHKEEMAAEAGEAVASPMDDGFVSLDSPSYVLYRHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 45874 - protein, 437 aa, Homo sapiens
MASPSSFTYYCPPSSSPVWSEPLYSLRPEHARERLQDDSVETVTSIEQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 45875 - protein, 650 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 45876 - protein, 490 aa, Homo sapiens
MILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 45877 - protein, 650 aa, Homo sapiens; identical to SEQ ID NO: 45875

SEQ ID NO: 45878 - protein, 498 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGTLQQFSYRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 45879 - protein, 408 aa, Homo sapiens [sequence omitted]

SEQ ID NO: 45880 - protein, 316 aa, Homo sapiens
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 45881 - protein, 316 aa, Homo sapiens; identical to SEQ ID NO: 45880

SEQ ID NO: 45882 - protein, 270 aa, Homo sapiens
MKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 45883 - protein, 390 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 45884 - protein, 306 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQSPLQAGPPTGREDARPGELPEAPRVAATALPKQHLQRLPAARSWSGRCRHRGGPRSRPRSAVAPRPAAGV

SEQ ID NO: 45885 - protein, 278 aa, Homo sapiens
MDFWLWPLYFLPEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 45886 - protein, 151 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMP

SEQ ID NO: 45887 - protein, 147 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYL

SEQ ID NO: 45888 - protein, 141 aa, Homo sapiens
MDFWLWPLYFLPEMESCCVAQDGLELVALSDPPGSASQSAGITVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNT

SEQ ID NO: 45889 - protein, 465 aa, Homo sapiens [sequence omitted]

SEQ ID NO: 45890 - protein, 549 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 45891 - protein, 408 aa, Homo sapiens
MRRPRGEPGPRAPRPTEGATCAGPGESCFPSDGPLVCALEQERRLRLPPKPPPPLQPLLRGGQGLEAALSCPRFLRYPRQHLISSLAEARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 45892 - protein, 159 aa, Homo sapiens
MLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGGTEVGPALWATELPAPGTAVYALP

SEQ ID NO: 45893 - protein, 522 aa, Homo sapiens
MRRPRGEPGPRAPRPTEGATCAGPGESWSPSPNSMLRVLLSAQTSPARLSGLLLIPPVQPCCLGPSKWGDRPVGGGPSAGPVQGLQRLLEQAKSPGELLRWLGQNPSKVRAHHYSVALRRLGQLLGSRPRPPPVEQVTLQDLSQLIIRNCPSFDIHTIHVCLHLAVLLGFPSDGPLVCALEQERRLRLPPKPPPPLQPLLREARPEELTPHVMVLLAQHLARHRLREPQLLEAIAHFLVVQETQLSSKVVQKLVLPFGRLNYLPLEQQFMPCLERILAREAGVAPLATVNILMSLCQLRCLPFRALHFVFSPGFINYISGTPHALIVRRYLSLLDTAVELELPGYRGPRLPRRQQVPIFPQPLITDRARCKYSHKDIVAEGLRQLLGEEKYRQDLTVPPGYCTDFLLCASSSGAVLPVRTQDPFLPYPPRSCPQGQAASSATTRDPAQRVVLVLRERWHFCRDGRVLLGSRALRERHLGLMGYQLLPLPFEELESQRGLPQLKSYLRQKLQALGLRWGPEGG

SEQ ID NO: 45894 - protein, 392 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 45895 - protein, 104 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEE

SEQ ID NO: 45896 - protein, 104 aa, Homo sapiens; identical to SEQ ID NO: 45895

SEQ ID NO: 45897 - protein, 472 aa, Homo sapiens
MTANGTAEAVQIQFGLINCGNKYLTAEAFGFKVNASASSLKKNHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 45898 - protein, 493 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 45899 - protein, 215 aa, Homo sapiens
MDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 45900 - protein, 516 aa, Homo sapiens
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGPPPRPAWTGKVAGGAAQQTLSPPGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 45901 - protein, 492 aa, Homo sapiens
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 45902 - protein, 710 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 45903 - protein, 710 aa, Homo sapiens; identical to SEQ ID NO: 45902

SEQ ID NO: 45904 - protein, 710 aa, Homo sapiens; identical to SEQ ID NO: 45902

SEQ ID NO: 45905 - protein, 124 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVD

SEQ ID NO: 45906 - protein, 764 aa, Homo sapiens
MAATLKSLKLVRYRAFCSPSAFGAVRSVSYWNVSSTQHGGQDPPEHISLCHSAKKVKNICSTFSSRRILTTSSAHPGLEFSKTSSSKASTLQLGSPRATGVDEEDVEVFDSFENMRVFLQLRPEYRVHSYNASETSQLLSVSEGELILHKVRVNQNNLQAQVIVDYLCKLSSLPAEQHPVLLGSTSFALLCQLSVKKIQLFDTQDLINVLKAFVILGIPHSHSMLDVYETKCCHQVWEMNMDQLLLVADLWRYLGRKVPRFLNIFSSYLNLHWKDLSLSQLVHLIYVIGENRQVSQDLMQKLESLILKYIDLINLEEVGTICLGFFKSSTNLSEFVMRKIGDLACANIQHLSSRSLVNIVKMFRFTHVDHINFMKQIGEIAPQRIPSLGVQGVMHLTLYCSALRFLNEGVMNAVAASLPPRVAHCRSKDVAKILWSFGTLNYKPPNAEEFYSSLISEIHRKMPEFNQYPEHLPTCLLGLAFLEYFPVELIDFALSPGFVRLAQERTKFDLLKELYTLDGTVGIECPDYRGNRLSTHLQQEGSELLWYLAEKDMNSKPEFLETVFLLETMLGGPQYVKHHMILPHTRSSDLEVQLDVNLKPLPFNREATPAENVAKLRLEHVGVSLTDDLMNKLLKGKARGHFQGKTESEPGQQPMELENKAAVPLGGFLCNVADKSGAMEMAGLCPAACMQTPRMKLAVQFTNRNQYCYGSRDLLGLHNMKRRQLARLGYRVVELSYWEWLPLLKRTRLEKLAFLHEKVFTSAL

SEQ ID NO: 45907 - protein, 60 aa, Homo sapiens
MACQGREECWCQSRIARTLPADQKPECRPYWEKDDASMPLPFDLTDIVSELRGQLLEAKP

SEQ ID NO: 45908 - protein, 209 aa, Homo sapiens
MLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 45909 - protein, 106 aa, Homo sapiens
MAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 45910 - protein, 106 aa, Homo sapiens; identical to SEQ ID NO: 45909

SEQ ID NO: 45911 - protein, 127 aa, Homo sapiens
MEWRKVSECNSVEPCREVKKWPYRCIHHGKNFSRMTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 45912 - protein, 505 aa, Homo sapiens
MKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 45913 - protein, 106 aa, Homo sapiens; identical to SEQ ID NO: 45909

SEQ ID NO: 45914 - protein, 4349 aa, Homo sapiens
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 45915 - protein, 4589 aa, Homo sapiens
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNASIVTVIQLVNNVVDTIENEVSVMDQGQNYNRAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 45916 - protein, 4557 aa, Homo sapiens
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 45917 - protein, 1254 aa, Homo sapiens
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGSCSVAQAGMQWHDHSSLQSRTPGFKGYPCLSLLSSWDYRHAPPCPATFLNS

SEQ ID NO: 45918 - protein, 3222 aa, Homo sapiens
MVTTVVAVGDTLAQPLAAAEVFIVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQYGDFISYCFKEKKCKKVCFTVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 45919 - protein, 4981 aa, Homo sapiens
MDLAPDRATGRPWLPLHTLSVSQLLRVFWLLSLLPGQAWVHGAEPRQVFQVLEEQPPGTLVGTIQTRPGFTYRLSESHALFAINSSTGALYTTSTIDRESLPSDVINLVVLSSAPTYPTEVRVLVRDLNDNAPVFPDPSIVVTFKEDSSSGRQVILDTATDSDIGSNGVDHRSYRIIRGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQAMDRGVPSLTGRAEALIQLLDVNDNDPVVKFRYFPATSRYASVDENAQVGTVVALLTVTDADSPAANGNISVQILGGNEQRHFEVQSSKVPNLSLIKVASALDRERIPSYNLTVSVSDNYGAPPGAAVQARSSVASLVIFVNDINDHPPVFSQQVYRVNLSEEAPPGSYVSGISATDGDSGLNANLRYSIVSGNGLGWFHISEHSGLVTTGSSGGLDRELASQIVLNISARDQGVHPKVSYAQLVVTLLDVNDEKPVFSQPEGYDVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITVLDTQDNPPVFSQVAYSFVVFENVALGYHVGSVSASTMDLNSNISYLITTGDQKGMFAINQVTGQLTTANVIDREEQSFYQLKVVASGGTVTGDTMVNITVKDLNDNSPHFLQAIESVNVVENWQAGHSIFQAKAVDPDEGVNGMVLYSLKQNPKNLFAINEKNGTISLLGPLDVHAGSYQIEILASDMGVPQLSSSVILTVYVHDVNDNSPVFDQLSYEVTLSESEPVNSRFFKVQASDKDSGANGEIAYTIAEGNTGDAFGIFPDGQLYIKSELDRELQDRYVLMVVASDRAVEPLSATVNVTVILEDVNDNRPLFNSTNYTFYFEEEQRAGSFVGKVSAVDKDFGPNGEVRYSFEMVQPDFELHAISGEITNTHQFDRESLMRRRGTAVFSFTVIATDQGIPQPLKDQATVHVYMKDINDNAPKFLKDFYQATISESAANLTQVLRVSASDVDEGNNGLIHYSIIKGNEERQFAIDSTSGQVTLIGKLDYEATPAYSLVIQAVDSGTIPLNSTCTLNIDILDENDNTPSFPKSTLFVDVLENMRIGELVSSVTATDSDSGDNADLYYSITGTNNHGTFSISPNTGSIFLAKKLDFETQSLYKLNITAKDQGRPPRSSTMSVVIHVRDFNDNPPSFPPGDIFKSIVENIPIGTSVISVTAHDPDADINGQLSYTIIQQMPRGNHFTIDEVKGTIYTNAEIDREFANLFELTVKANDQAVPIETRRYALKNVTILVTDLNDNVPMFISQNALAADPSAVIGSVLTTIMAADPDEGANGEIEYEIINGDTDTFIVDRYSGDLRVASALVPSQLIYNLIVSATDLGPERRKSTTELTIILQGLDGPVFTQPKYITILKEGEPIGTNVISIEAASPRGSEAPVEYYIVSVRCEEKTVGRLFTIGRHTGIIQTAAILDREQGACLYLVDVYAIEKSTAFPRTQRAEVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGKMCESSVNYCECNPCFNGGSCQSGVDSYYCHCPFGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQCPRLEGACTRSPCQHGGTCMDYWSWQQCHCKEGLTGKYCEKSVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 45920 - protein, 372 aa, Homo sapiens
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 45921 - protein, 159 aa, Homo sapiens
MFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 45922 - protein, 579 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 45923 - protein, 151 aa, Homo sapiens
RRQHPLPLLLLRHLRPQAHREPPQVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRCRPLP

SEQ ID NO: 45924 - protein, 532 aa, Homo sapiens
MAPSFTARIQLFLLRALGFLIGLVGRAALVLGGPKFASKTPRPVTEPLLLLSGMQLAKLIRQRKVKCIDVVQAYINRIKDVNPMINGIVKYRFEEAMKEAHAVDQKLAEKQEDEATLENKWPFLGVPLTVKEAFQLQGMPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPGVVPNKGQFPLAVGAQELFLCTGPMCRYAEDLAPMLKVMAGPGIKRLKLDTKVHLKDLKFYWMEHDGGSFLMSKVDQDLIMTQKKVVVHLETILGASVQHVKLKKMKYSFQLWIAMMSAKGHDGKEPVKFVDLLGDHGKHVSPLWELIKWCLGLSVYTIPSIGLALLEEKLRYSNEKYQKFKAVEESLRKELVDMLGDDGVFLYPSHPTVAPKHHVPLTRPFNFAYTGVFSALGLPVTQCPLGLNAKGLPLGIQVVAGPFNDHLTLAVAQYLEKTFGGWVCPGKF

SEQ ID NO: 45925 - protein, 127 aa, Homo sapiens
MSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISKRI

SEQ ID NO: 45926 - protein, 132 aa, Homo sapiens
MAFDSTWKVDRSENYDKFMEKMGVNIVKRKLAAHDNLKLTITQEGNKFTVKESSTFRNIEVVFELGVTFNYNLADGTELRGTWSLEGNKLIGKFKRTDNGNELNTVREIIGDELVQTYVYEGVEAKRIFKKD

SEQ ID NO: 45927 - protein, 133 aa, Homo sapiens [sequence omitted]

SEQ ID NO: 45928 - protein, 135 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 45929 - protein, 177 aa, Homo sapiens
MKTVTMMMVVEMQALTQVLRAVLSACTWVSRKGDLQRMKQTHKGKPPSSMAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 45930 - protein, 177 aa, Homo sapiens; identical to SEQ ID NO: 45929

SEQ ID NO: 45931 - protein, 128 aa, Homo sapiens
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 45932 - protein, 166 aa, Homo sapiens
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMVSNDNSPFFLVFFSSPHTSHLLPSSSLLLPFFLLPSFFNNTSLARFFNYM

SEQ ID NO: 45933 - protein, 132 aa, Homo sapiens
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 45934 - protein, 501 aa, Homo sapiens
MGTRAARPAGLPCGAENPARRRLALGARQQIHSWSPRTPSTRLTAPAGPARGVARPAMAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 45935 - protein, 360 aa, Homo sapiens
MNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 45936 - protein, 360 aa, Homo sapiens; identical to SEQ ID NO: 45935

SEQ ID NO: 45937 - protein, 360 aa, Homo sapiens; identical to SEQ ID NO: 45935

SEQ ID NO: 45938 - protein, 376 aa, Homo sapiens
QDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 45939 - protein, 422 aa, Homo sapiens
MHGREAGPFVCVCVLLASIPTPQTPLLQASLPPFHPASAGHPITGQQDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 45940 - protein, 444 aa, Homo sapiens
MGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 45941 - protein, 386 aa, Homo sapiens
MGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHQ

SEQ ID NO: 45942 - protein, 445 aa, Homo sapiens
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 45943 - protein, 385 aa, Homo sapiens [sequence omitted]

SEQ ID NO: 45944 - protein, 338 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 45945 - protein, 302 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 45946 - protein, 195 aa, Homo sapiens
MFQAFPGDYDSGSRCSSSPSAESQYLSSVDSFGSPPTAAASQETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 45947 - protein, 291 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEEVQVLGDPFPVVNPSYTSSFVLTCPEVSAFAGAQRTSGSDQPSDPLNSPSLLAL

SEQ ID NO: 45948 - protein, 303 aa, Homo sapiens
MSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 45949 - protein, 314 aa, Homo sapiens
MSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVRVDYQVVCFLHISIVNSLMSYPLSFSISTPVYYILYIHFICIYAIIAMHCLPAFVN

SEQ ID NO: 45950 - protein, 701 aa, Homo sapiens
MGHLLSKEPRNRPSQKRPRCCSWCRRRRPLLRLPRRTPAKVPPQPAAPRSRDCFFRGPCMLCFIVHSPGAPAPAGPEEEPPLSPPPRDGAYAAASSSQHLARRYAALAAEDCAAAARRFLLSSAAAAAAAAASASSPASCCKELGLAAAAAWEQQGRSLFLASLGPVRFLGPPAAVQLFRGPTPSPAELPTPPEMVCKRKGAGVPACTPCKQPRCGGGGCGGGGGGGGGGGPAGGGASPPRPPDAGCCQAPEQPPQPLCPPPSSPTSEGAPTEAGGDAVRAGGTAPLSAQQQHECGDADCRESPENPCDCHREPPPETPDINQLPPSILLKIFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 45951 - protein, 674 aa, Homo sapiens
MSSSSRGPGAGARRRRTRCRRCRACVRTECGDCHFCRDMKKFGGPGRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKVGGDACLLRGSDPGGPGLLPPRVLNPSQAFSSCHPGLPPENWEKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 45952 - protein, 694 aa, Homo sapiens
MGMKVPGKGESGPSALLTPPMSSSSRGPGAGARRRRTRCRRCRACVRTECGDCHFCRDMKKFGGPGRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKVGGDACLLRGSDPGGPGLLPPRVLNPSQAFSSCHPGLPPENWEKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 45953 - protein, 586 aa, Homo sapiens
  MOD_RES (1)..(1): Any amino acid
XRMKQSCLLRQCTAPVLPHTAVCLLCGEAGKEDTVEGEEEKFGLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKVKGGRERHLKKKPKPPLASAEGPAVPSPSPQREKLERFKRMCQLLERVPDTSSSSSDSDSDSDSSGTSLSEDEAPGEARNGRRPARGSSGEKENRGGRRAVRPGSGGPLLSWPLGPAPPPRPPQLERHVVRPPPRSPEPDTLPLAAGSDHPLPRAAWLRVFQHLGPRELCICMRVCRTWSRWCYDKRLWPRMDLSRRKSLTPPMLSGVVRRQPRALDLSWTGVSKKQLMWLLNRLQGLQELVLSGCSWLSVSALGSAPLPALRLLDLRWIEDVKDSQLRELLLPPPDTKPGQTESRGRLQGVAELRLAGLELTDASLRLLLRHAPQLSALDLSHCAHVGDPSVHLLTAPTSPLRETLVHLNLAGCHRLTDHCLPLFRRCPRLRRLDLRSCRQLSPEACARLAAAGPPGPFRCPEEKLLLKDS

SEQ ID NO: 45954 - protein, 164 aa, Homo sapiens
MDLEECILITDSTLIQLSIHCPKLQALVSLSFSDIIHLLKMKEPSHHNKKLFGFSFCKSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 45955 - protein, 423 aa, Homo sapiens
MVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 45956 - protein, 339 aa, Homo sapiens
MYIALVWILFVMWTFAQNCRNIEHLNLNGCTKITDSTCYSLSRFCSKLKHLDLTSCVSITNSSLKGISEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 45957 - protein, 355 aa, Homo sapiens
MVFSNNDEGLINKKLPKELLLRIFSFLDIVTLCRCAQISKAWNILALDGSNWQRIDLFNFQTDVEGRVVENISKRCGGFLRKLSLRGCIGVGDSSLKTFAQNCRNIEHLNLNGCTKITDSTCYSLSRFCSKLKHIQNYCHELVSLNLQSCSRITDEGVVQICRGCHRLQALCLSGCSNLTDASLTALGLNCPRLQILEAARCSHLTDAGFTLLARNCHELEKMDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 45958 - protein, 133 aa, Homo sapiens
MDLEECILITDSTLIQLSIHCPKLQALSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 45959 - protein, 355 aa, Homo sapiens; identical to SEQ ID NO: 45957

SEQ ID NO: 45960 - protein, 621 aa, Homo sapiens
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGTRMVSPASLRKLLESCKDLSLLDVSFCSQIDNRAVLELNASFPKVFIKKSFTQ

SEQ ID NO: 45961 - protein, 621 aa, Homo sapiens; identical to SEQ ID NO: 45960

SEQ ID NO: 45962 - protein, 691 aa, Homo sapiens
MAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 45963 - protein, 565 aa, Homo sapiens
MKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 45964 - protein, 674 aa, Homo sapiens
MAPFPEEVDVFTAPHWRMKQLVGLYCDKSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 45965 - protein, 479 aa, Homo sapiens
GKGSSSISSDVSSSTDHTPTKAQKNVATSEDSDLSMRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 45966 - protein, 491 aa, Homo sapiens
MGANNGKQYGSEGKGSSSISSDVSSSTDHTPTKAQKNVATSEDSDLSMRTLSTPSPALICPPNLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVTVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCASIKELSVSDCRFVSDFGLREIAKLESRLRYLSIAHCGRVTDVGIRYVAKYCSKLRYLNARGCEGITDHGVEYLAKNCTKLKSLDIGKCPLVSDTGLECLALNCFNLKRLSLKSCESITGQGLQIVAANCFDLQTLNVQDCEVSVEALRFVKRHCKRCVIEHTNPAFF

SEQ ID NO: 45967 - protein, 999 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDADDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 45968 - protein, 1061 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILSMLGCMRGFPRHLPSWPSSGVSGSIFFFPGMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSDDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 45969 - protein, 1052 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDADDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 45970 - protein, 1051 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDDDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 45971 - protein, 542 aa, Homo sapiens
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 45972 - protein, 529 aa, Homo sapiens
MEPDSVIEDKTIELMNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 45973 - protein, 508 aa, Homo sapiens
MEPDSVIEDKTIELMISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 45974 - protein, 510 aa, Homo sapiens
MEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 45975 - protein, 464 aa, Homo sapiens
MEIRLPDLALKRIFSFLDLFGLLQVSQVNKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEGTMIWSSPVQEFHFSNLVTLPQMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 45976 - protein, 363 aa, Homo sapiens
MLALRDEPHSPDSRSQAFETELAYLSGNRLTVDEQEKSIICSVSPKQELCAWDVQEMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 45977 - protein, 394 aa, Homo sapiens
MEIRLPDLALKRIFSFLDLFGLLQVSQVNKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 45978 - protein, 445 aa, Homo sapiens
MSPTHQIQDPKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEGTMIWSSPVQEFHFSNLVTLPQMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 45979 - protein, 412 aa, Homo sapiens
MAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCRQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 45980 - protein, 412 aa, Homo sapiens
MAAAAGEEEEEEEAARESAARPAAGPALWRLPEELLLLICSYLDMRALGRLAQVCRWLRRFTSCDLLWRRIARASLNSGFTRLGTDLMTSVPVKERVKVSQNWRLGRCREGILLKWRCSQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 45981 - protein, 212 aa, Homo sapiens
MRALGRLAQVCRWLRRFTSCDLLWRRIARASLNSGFTRLGTDLMTSVPVKERVKVSQNWRLGRCREGILLKWRCRQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLL

SEQ ID NO: 45982 - protein, 191 aa, Homo sapiens
MTSVPVKERVKVSQNWRLGRCREGILLKWRCRQMPWMQLEDDSLYISQANFILAYQFRPDGASLNRRPLGVFAGHDEDVCHFVLANSHIVSAGGDGKIGIHKIHSTFTVKYSAHEQEVNCVDCKGGIIVSGSRDRTAKVWPLASGRLGQCLHTIQTEDRVWSIAISPLLSSFVTGTACCGHFSPLRIWDLN

SEQ ID NO: 45983 - protein, 627 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 45984 - protein, 707 aa, Homo sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 45985 - protein, 589 aa, Homo sapiens
MSKPGKPTLNHGLVPVDLKSAKEPLPHQTVMKIFSISIIAQGLPFCRRRMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 45986 - protein, 531 aa, Homo sapiens
MLFFKCISLLLIWLIPGQSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 45987 - protein, 598 aa, Homo sapiens
MDDYSLDEFRRRWQEELAQAQAPKKRRRPEAAERRARRPEVGSGRGEQASGDPALAQRLLEGAGRPPAARATRAEGQDVASRSRSPLAREGAGGGEQLVDQLIRDLNEMNDVPFFDIQLPYELAINIFQYLDRKELGRCAQVSKTWKVIAEDEVLWYRLCQQEGHLPDSSISDYSCWKLIFQECRAKEHMLRTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 45988 - protein, 532 aa, Homo sapiens
MDDYSLDEFRRRWQEELAQAQAPKKRRRPEAAERRARRPENEMNDVPFFDIQLPYELAINIFQYLDRKELGRCAQVSKTWKVIAEDEVLWYRLCQQEGHLPDSSISDYSCWKLIFQECRAKEHMLRTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 45989 - protein, 532 aa, Homo sapiens; identical to SEQ ID NO: 45988

SEQ ID NO: 45990 - protein, 956 aa, Homo sapiens
MEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLILCNQIHHGLRSGIVVLGNGKGIIRNNQIFSNKEAGIYILYHGNPVVSGNHIFKGRAAGIAVNENGKGLITENVIRENQWGGVDIRRGGIPVLRSNLICFGYSDGVVVGDEGKGLIEGNTIYANKGCGVWMMSSSLPHVTSNHVSYNGLYGVAVFSQKDGSSELPRGHRAQENFSEDGDAILWETELEKEDDPLRRPITIALVESNSINHNGASGLYVQSSEALHVITNVIHANGDRGITVAQSSQPTRVANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKSDTWRLVNPPARPHLENSLRRPSAAHNGQKVTAMATRITARVEGGYHSNRSVFCTIL

SEQ ID NO: 45991 - protein, 71 aa, Homo sapiens
MEAGGLPLELWRMILAYLHLPDLGRCSLVCRAWYELILSLDSTRWRQLCLGCTECRHPNWPNQPDVEPESW

SEQ ID NO: 45992 - protein, 481 aa, Homo sapiens
MLRNDIYRCRASGIFLRLEGGGLIAGNNIYHNAEAGVDIRKKSNPLILCNQIHHGLRSGIVVLGNGKGIIRNNQIFSNKEAGIYILYHGNPVVSGNHIFKGRAAGIAVNENGKGLITENVIRENQWGGVDIRRGGIPVLRSNLICFGYSDGVVVGDEGKGLIEGNTIYANKGCGVWMMSSSLPHVTSNHVSYNGLYGVAVFSQKDGSSELPRGHRAQENFSEDGDAILWETELEKEDDPLRRPITIALVESNSINHNGASGLYVQSSEALHVITNVIHANGDRGITVAQSSQPTRVANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKSDTWRLVNPPARPHLENSLRRPSAAHNGQKVTAMATRITARVEGGYHSNRSVFCTIL

SEQ ID NO: 45993 - protein, 843 aa, Homo sapiens
MVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPILWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 45994 - protein, 93 aa, Homo sapiens
MEGASTSTTENFGHRAKRARVSGKSQDLSAAPAEQYLQEKLPDEVVLKIFSYLLEQDLCRAACVCKRFSELANDPILWLGEVAHAYNPSTLGG

SEQ ID NO: 45995 - protein, 843 aa, Homo sapiens; identical to SEQ ID NO: 45993

SEQ ID NO: 45996 - protein, 927 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPILWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 45997 - protein, 351 aa, Homo sapiens [sequence omitted]

SEQ ID NO: 45998 - protein, 434 aa, Homo sapiens
MPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 45999 - protein, 510 aa, Homo sapiens
MATGRGRILQQHWLGLQTLRGPSRGGGAARGRARAFGCRKGPGVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 46000 - protein, 292 aa, Homo sapiens
MMAFAPPKNTDGPKMQTKMSTWTPLNHQLLNDRVFEERRALLGKWFDKWTDSQRRRILTGLLERCSLSQQKFCCRKLQEKIPAEALDFTTKLPRVLSLYIFSFLDPRSLCRCAQVCWHWKNLAELDQLWMLKCLRFNWYINFSPTPFEQGIWKKHYIQMVKELHITKPKTPPKDGFVIADVQLVTSNSPEEKQSPLSAFRSSSSLRKKNNSGEKALPPWRSSDKHPTDIIRFNYLDNRDPMETVQQGRRKRNQMTPDFSRQSHDKKNKLQDRTRLRKAQSMMSRRNPFPLCP

SEQ ID NO: 46001 - protein, 296 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESVKKYFASSFEWCRKAQVIDLQAEGYWEELLDTTQPAIVVKDWYSGRSDAGCLYELTVKLLSEHENVLAEFSSGQVAVPQDSDGGGWMEISHTFTDYGPGVRFVRFEHGGQDSVYWKGWFGARVTNSSVWVEP

SEQ ID NO: 46002 - protein, 197 aa, Homo sapiens
MDGDGDPESVGQPEEASPEEQPEEASAEEERPEDQQEEEAAAAAAYLDELPEPLLLRVLAALPAAELVQACRLVCLRWKELVDGAPLWLLKCQQEGLVPEGGVEEERDHWQQFYFLSKRRRNLLRNPCGEEDLEGWCDVEHGGDGWRVEELPGDSGVEFTHDESAPVLPGGVAKHRGLLGGAAGHDSAGHRGEGLVR

SEQ ID NO: 46003 - protein, 537 aa, Homo sapiens
MKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 46004 - protein, 628 aa, Homo sapiens
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKSFCLVLKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 46005 - protein, 621 aa, Homo sapiens
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 46006 - protein, 477 aa, Homo sapiens
MKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGEGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 46007 - protein, 403 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 46008 - protein, 276 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKYVLCASDFVCE

SEQ ID NO: 46009 - protein, 299 aa, Homo sapiens
MADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 46010 - protein, 580 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 46011 - protein, 318 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQDTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDPILCSWLQPPWPGG

SEQ ID NO: 46012 - protein, 618 aa, Homo sapiens
MVWESQQERGGQGPRRQEGRSREGAIRMVRGSQRRKLQKFTRLCGREEGLRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 46013 - protein, 318 aa, Homo sapiens; identical to SEQ ID NO: 46011

SEQ ID NO: 46014 - protein, 568 aa, Homo sapiens
MVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 46015 - protein, 367 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDYHLALLFKDSGHPCTAADPDSCFTPVSPQHFIDLFKF

SEQ ID NO: 46016 - protein, 358 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 46017 - protein, 291 aa, Homo sapiens
MEKYSIMKSMNMHRKKGKRTILEMTQILKRHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 46018 - protein, 291 aa, Homo sapiens; identical to SEQ ID NO: 46017

SEQ ID NO: 46019 - protein, 330 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 46020 - protein, 125 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYV

SEQ ID NO: 46021 - protein, 283 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 46022 - protein, 283 aa, Homo sapiens; identical to SEQ ID NO: 46021

SEQ ID NO: 46023 - protein, 368 aa, Homo sapiens
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKVIDEIYRVLRYVNSTRAPQRAHEVLQELRDISSMAMEYFDEKIVPILKRKLPGSDVSGRLMGSPPVPGPSAALTTMQLFSKQNPSRQEVTKLQQQVKTNGAGVTVLRREISELRTKVQEQQKQLQDQDQKLLEQTQIIGEQNARLAELERKLREVMESAVGNSSGSGQNEESPRKRKKATEAIDSLRKSKRLRNRK

SEQ ID NO: 46024 - protein, 179 aa, Homo sapiens
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKFQDRLQP

SEQ ID NO: 46025 - protein, 471 aa, Homo sapiens
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 46026 - protein, 172 aa, Homo sapiens
METETAPLTLESLPTDPLLLILSFLDYRDLINCCYVSRRLSQLSSHDPLWRRHCKKYWLISEEEKTQKNQCWKSLFIDTYSDVGRYIDHYAAIKKAGMISRNIWSPGVLGWFVSINRGCSRGRPRCCGSADWCKLPDDYRCSYRIHNGQKLVVPGSYWEAWHCLITIVLKIC

SEQ ID NO: 46027 - protein, 415 aa, Homo sapiens
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLVS

SEQ ID NO: 46028 - protein, 745 aa, Homo sapiens
MEEELQHSHCVNCVSRRCMTRPEPGISCDLIGCPLVCGAVFHSCKADEHRLLCPFERVPCLNSDFGCPFTMARNKVAEHLEMCPASVVCCTMEWNRWPVSYADRKSYENLSRDVDEVAQLDMALALQDQRMLLESLKVATMMSKATDKVSKPREQISVKSSVPEIPHANGLVSVDEESYGALYQATVETTRSLAAALDILNTATRDIGMLNTSVPNDMDEQQNARESLEDQNLKDQDHLYEEEIGAVGGIDYNDTNQNAQSEQNGSSDLLCDLNTSSYDTSALCNGFPLENICTQVIDQNQNLHGDSKQSNLTNGDCVASSDGTSKPSSSLAVAAQLREIIPSSALPNGTVQHILMPDDEGEGELCWKKVDLGDVKNVDVLSFSHAPSFNFLSNSCWSKPKEDKAVDTSDLEVAEDPMGLQGIDLITAALLFCLGDSPGGRGISDSRMADIYHIDVGTQTFSLPSAILATSTMVGEIASASACDHANPQLSNPSPFQTLGLDLVLECVARYQPKQRSMFTFVCGQLFRRKEFSSHFKNVHGDIHAGLNGWMEQRCPLAYYGCTYSQRRFCPSIQGAKIIHDRHLRSFGVQPCVSTVLVEPARNCVLGLHNDHLSSLPFEVLQHIAGFLDGFSLCQLSCVSKLMRDVCGSLLQSRGMVILQWGKRKYPEGNSSWQIKEKVWRFSTAFCSVNEWKFADILSMADHLKKCSYNVVEKREEAIPLPCMCVTRELTKEGRSLRSVLKPVL

SEQ ID NO: 46029 - protein, 539 aa, Homo sapiens
MAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 46030 - protein, 355 aa, Homo sapiens
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 46031 - protein, 262 aa, Homo sapiens
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 46032 - protein, 555 aa, Homo sapiens
MLLFLSVPQPRPPGARTRAGAARVARWRRLRLQQLRRLRGLLRVLRGRPGAGSRRRGRMALCGQAAGAASLPSELIVHIFSFLPAPDRLRASASCSHWRECLFYPALWPQLRICLRVSPAEQPRLEFLMRKCGWFVRELRVEFAAENYLSGGGPGDGGGADTGTGGEEVEALQLSARWLEVLRTYLELVLCVLVSIRNNRNLQKFSLFGDISVLQQQGSLSNTYLSKVDPDGKKIKQIQQLFEEILSNSRQLKWLSCGFMLEIVTPTSLSSLSNAVANTMEHLSLLDNNIPGNSTLITAVELERFVNLHSLALDFCDFTAEMARVLTDSNHVPLQRLSLLVHNVSVMHKSLDNMPNDEHWKALSRKSTSFRVYIMAFDIKSEDMLKILKPSIPLERIHFDSYITCVSGAIVDLISRQYDKFLTHFILMNDVIDTSGFPDLSDNRNEDPLVLLAWRCTKLSLLAIHGYTVWAHNLIAIARLRGSDLKVLEVTEESIDFDQGELADQDVDPVHNLIEQVSLGLGQPWHAVMDIESLSVFTEPNRHFYREMQSFSEDI

SEQ ID NO: 46033 - protein, 2 aa, Homo sapiens
MR

SEQ ID NO: 46034 - protein, 711 aa, Homo sapiens
MHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVLPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 46035 - protein, 711 aa, Homo sapiens; identical to SEQ ID NO: 46034

SEQ ID NO: 46036 - protein, 188 aa, Homo sapiens
MASWLPETLFETVGQGPPPSKDYYQLLVTRSQVIFRWWKISLRSEYRSTKPGEAKETHEDFLENSHLQGQTALIFGARILDYVINLCKGKFDFLERLSDDLLLTIISYLDLEDIARLCQTSHRFAKLCMSDKLWEQIVQSTCDTITPDVRALAEDTGWRQLFFTNKLQLQRQLRKRKQKYGNLREKQP

SEQ ID NO: 46037 - protein, 943 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 46038 - protein, 1188 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 46039 - protein, 1113 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 46040 - protein, 943 aa, Homo sapiens; identical to SEQ ID NO: 46037

SEQ ID NO: 46041 - protein, 442 aa, Homo sapiens
MDEESELIQPQDQSCWAFLPDLCLCRVFWWLGDRDRSRAALVCRKWNQMMYSAELWRYRTITFSGRPSRVHASEVESAVWYVKKFGRYLEHLEVKFMNPYNAVLTKKFQVTMRGLLSCLSKSNNRLKSLSIQYLELDRLVWRNSIRSSFISSLSFFLKKMGKRLDYLNLKGARLTVEQGCQILDSLSYMRNENVISELNIEDYFSHHLAVYNSPQFKKTMSTFHNLVSLNLNYNCISDELLENLCENASTLRTINIKCHVHDPHGQVIWGMSWAKLARQATNLKVNFFFERIMKYERLARILLQEIPIRSISLRSCYFSDPDCSMRPTLIDLLPTFRHTLQKLTCEFNNNHESLDEELHLLIISCRKLFYFKIWAFLDVSFVERILKSQKERQCALRVFKARIYTNRYETNEEDKTLQEIYRKYRKLIESELSYFVIVYSVM

SEQ ID NO: 46042 - protein, 387 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKRHEWQDEFSHIMAMTDPAFGSSGRPLLVLSCISQGDVKRMPCFYLAHELHLNLLNHPWLVQDTEAETLTGFLNGIEWILEEVESKRAR

SEQ ID NO: 46043 - protein, 307 aa, Homo sapiens
MAGSEPRSGTNSPPPPFSDWGRLEAAILSGWKTFWQSVSKERVARTTSREEVDEAASTLTRLPIDVQLYILSFLSPHDLCQLGSTNHYWNETVRDPILWRYFLLRDLPSWSSVDWKSLPDLEILKKPISEVTDGAFFDYMAVYRMCCPYTRRASKSSRPMYGAVTSFLHSLIIQNEPRFAMFGPGLEELNTSLVLSLMSSEELCPTAGLPQRQIDGIGSGVNFQLNNQHKFNILILYSTTRKERDRAREEHTSAVNKMFSRHNEGDDQQGSRYSVIPQIQKVCEVVDGFIYVANAEAHKSKYSYVHF

SEQ ID NO: 46044 - protein, 709 aa, Homo sapiens
MGKARRSPPGHHRHCEGCFNRHCHIPVEPNTSCLVISCHLLCGATFHMCKEAEHQLLCPLEQVPCLNSEYGCPLSMSRHKLAKHLQVCPASVVCCSMEWNRWPNVDSETTLHENIMKETPSEECLDTALALQDQKVLFRSLKMVELFPETREATEEEPTMNGETSVEEMGGAVGGVDIGLVPHGLSATNGEMAELSQEEREVLAKTKEGMDLVKFGQWENIFSKEHAASALTNSSASCESKNKNDSEKEQISSGHNMVEGEGAPKKKEPQENQKQQDVRTAMETTGLAPWQDGVLERLKTAVDAKDYNMYLVHNGRMLIHFGQMPACTPKERDFVYGKLEAQEVKTVYTFKVPVSYCGKRARLGDAMLSCKPSEHKAVDTSDLGITVEDLPKSDLIKTTLQCALERELKGHVISESRSIDGLFMDFATQTYNFEPEQFSSGTVLADLTAATPGGLHVELHSECVTRRHNKSSSAFTFTCNKFFRRDEFPLHFKNVHTDIQSCLNGWFQHRCPLAYLGCTFVQNHFRPPGQKAKVIYSQELKTFAIKPEVAPELSEGRKNNHLLGHGGKSQNSLTSLPLEILKYIAGFLDSVSLAQLSQVSVLMRNICATLLQERGMVLLQWKKKRYSHGGTSWRVHREIWQFSSLFSKIKSWEFNEVTSMSEHLKSCPFNIVEHKTDPILLTSMCQPREQARESLVSTFRIRPRGRYVS

SEQ ID NO: 46045 - protein, 936 aa, Homo sapiens
MTTGLSDQQVVCDLDHRAVEALLQAVRKRMAGASPAVPHERARLTGGAAAVEPACRGGGGAMASLDLPYRCPRCGEHKRFRSLSSLRAHLEYSHTYETLYILSKTNSICDGAAAAAAAAAAASGFPLAPEPAALLAVPGARREVFESTSFQGKEQAAGPSPAAPHLLHHHHHHAPLAHFPGDLVPASLPCEELAEPGLVPAAAARYALREIEIPLGELFARKSVASSACSTPPPGPGPGPCPGPASASPASPSPADVAYEEGLARLKIRALEKLEVDRRLERLSEEVEQKIAGQVGRLQAELERKAAELETARQESARLGREKEELEERASELSRQVDVSVELLASLKQDLVHKEQELSRKQQEVVQIDQFLKETAAREASAKLRLQQFIEELLERADRAERQLQVISSSCGSTPSASLGRGGGGGGAGPNARGPGRMREHHVGPAVPNTYAVSRHGSSPSTGASSRVPAASQSSGCYDSDSLELPRPEEGAPEDSGPGGLGTRAQAANGGSERSQPPRSSGLRRQAIQNWQRRPRRHSTEGEEGDVSDVGSRTTESEAEGPLDAPRPGPAMAGPLSSCRLSARPEGGSGRGRRAERVSPSRSNEVISPEILKMRAALFCIFTYLDTRTLLHAAEVCRDWRFVARHPAVWTRVLLENARVCSKFLAMLAQWCTQAHSLTLQNLKPRQRGKKESKEEYARSTRGCLEAGLESLLKAAGGNLLILRISHCPNILTDRSLWLASCYCRALQAVTYRSATDPVGHEVIWALGAGCREIVSLQVAPLHPCQQPTRFSNRCLQMIGRCWPHLRALGVGGAGCGVQGLASLARNCMRLQVLELDHVSEITQEVAAEVCREGLKGLEMLVLTATPVTPKALLHFNSICRNLKSIVVQIGIADYFKEPSSPEAQKLFEDMVTKLQALRRRPGFSKILHIKVEGGC

SEQ ID NO: 46046 - protein, 875 aa, Homo sapiens
MASLDLPYRCPRCGEHKRFRSLSSLRAHLEYSHTYETLYILSKTNSICDGAAAAAAAAAAASGFPLAPEPAALLAVPGARREVFESTSFQGKEQAAGPSPAAPHLLHHHHHHAPLAHFPGDLVPASLPCEELAEPGLVPAAAARYALREIEIPLGELFARKSVASSACSTPPPGPGPGPCPGPASASPASPSPADVAYEEGLARLKIRALEKLEVDRRLERLSEEVEQKIAGQVGRLQAELERKAAELETARQESARLGREKEELEERASELSRQVDVSVELLASLKQDLVHKEQELSRKQQEVVQIDQFLKETAAREASAKLRLQQFIEELLERADRAERQLQVISSSCGSTPSASLGRGGGGGGAGPNARGPGRMREHHVGPAVPNTYAVSRHGSSPSTGASSRVPAASQSSGCYDSDSLELPRPEEGAPEDSGPGGLGTRAQAANGGSERSQPPRSSGLRRQAIQNWQRRPRRHSTEGEEGDVSDVGSRTTESEAEGPLDAPRPGPAMAGPLSSCRLSARPEGGSGRGRRAERVSPSRSNEVISPEILKMRAALFCIFTYLDTRTLLHAAEVCRDWRFVARHPAVWTRVLLENARVCSKFLAMLAQWCTQAHSLTLQNLKPRQRGKKESKEEYARSTRGCLEAGLESLLKAAGGNLLILRISHCPNILTDRSLWLASCYCRALQAVTYRSATDPVGHEVIWALGAGCREIVSLQVAPLHPCQQPTRFSNRCLQMIGRCWPHLRALGVGGAGCGVQGLASLARNCMRLQVLELDHVSEITQEVAAEVCREGLKGLEMLVLTATPVTPKALLHFNSICRNLKSIVVQIGIADYFKEPSSPEAQKLFEDMVTKLQALRRRPGFSKILHIKVEGGC

SEQ ID NO: 46047 - protein, 717 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 46048 - protein, 299 aa, Homo sapiens [sequence omitted]

SEQ ID NO: 46049 - protein, 299 aa, Homo sapiens [sequence omitted]

SEQ ID NO: 46050 - protein, 708 aa, Homo sapiens
MSFKDKDERISCLEAYVTLTSKSSRFTDETEILKMSQRHSGQAGTEAGNGADSPPIVNSKYSTFRDFCSTSSFQDSGYNELKSCSFDNIDKEYLGKKEKGPTLLYEHPETSGLGLTHPLESPTQKKKCILPRKEKDKTPELCETPKISGKKCLPRRRLNVSFALLKGDFESQNSSLESSISQVINLEKNIPSSASGFSRANNFSPLVTSTLKTEEVTSCSQKLRLNFSQQKTSTIDDSKDDCSLFEVECISPIQGNNFKDSITHDFSDSSLCINDENACPELLGSSVSGTTCGTDEDIFVTPISNLVANIRFNASQILSPSPEVRGSISTPEDSGFNSLSLEKSEDSLSDQEGSFQELLQKHKGTPKVGDTIRKTRHLGRSRRLSTLREQSSQSETEEEKQIVHPDSEKRAAAASAISEGQLSSDESGDLTFSLKNLSKTPALQLVHELFMKSKRKRLQENSGHEFLEQGDGEKIAVLQCILAGLIGKKMGIEKLDILTELKYRNLKHILAMVLESLTAESLCSVWKVSRNWREIVVQDKNANRRRKFYITQLKTDSEGAVLNVEDAATRLQLLNRSALRSVQAQARIPGSQREQGSTLSPWGEVLTPLASSSVTHLSSKQEEYVKVAKTLFTDEALKPCPRCQSPAKYQPYKKRGLCSRTACGFDFCVLCLCAYHGSEECSRGAAKPRNRKDALPGSAQSKRNLKRL

SEQ ID NO: 46051 - protein, 224 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 46052 - protein, 255 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVKKYFVTSYYTCLKSQVVDLKAEGYWEELMDTTRPDIEVKDWFAARPDCGSKYQLCVQLLSSAHAPLGTFQPDPATIQQKSDAKWREVSHTFSNYPPGVRYIWFQHGGVDTHYWAGWYGPRVTNSSITIGPPLP

SEQ ID NO: 46053 - protein, 224 aa, Homo sapiens; identical to SEQ ID NO: 46051

SEQ ID NO: 46054 - protein, 224 aa, Homo sapiens; identical to SEQ ID NO: 46051

SEQ ID NO: 46055 - protein, 256 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQHLPQVPGGGPQGRRVLGGADGYHTAGHRGQGLVRSQARLRVQVPAVRSAPVVRARASGDLPARPGDHPAEERCQVEGGLPHILQLPARRPLHLVSARRRGHSLLGRLVRPEGHQQQHHHRAPAALTPPEPPSAEP

SEQ ID NO: 46056 - protein, 255 aa, Homo sapiens; identical to SEQ ID NO: 46052

SEQ ID NO: 46057 - protein, 165 aa, Homo sapiens
MAVGNINELPENILLELFTHVPARQLLLNCRLVCSLWRDLIDLVTLWKRKCLREGFITEDWDQPVADWKIFYFLRSLHRNLLHNPCAEEGFEFWSLDVNGGDEWKVEDLSRDQRKEFPNDQVRSQARLRVQVPAVRSAPVVRARASGDLPARPGDHPAEERCQVE

SEQ ID NO: 46058 - protein, 286 aa, Homo sapiens
MAAPAPGAGAASGGAGCSGGGAGAGAGSGSGAAGAGGRLPSRVLELVFSYLELSELRSCALVCKHWYRCLHGDENSEVWRSLCARSLAEEALRTDILCNLPSYKAKIRAFQHAFSTNDCSRNVYIKKNGFTLHRNPIAQSTDGARTKIGFSEGRHAWEVWWEGPLGTVAVIGIATKRAPMQCQGYVALLGSDDQSWGWNLVDNNLLHNGEVNGSFPQCNNAPKYQIGERIRVILDMEDKTLAFERGYEFLGVAFRGLPKVCLYPAVSAVYGNTEVTLVYLGKPLDG

SEQ ID NO: 46059 - protein, 603 aa, Homo sapiens
MDRGSLLPFQLWCPRPFGTYSQNQPRPPSAALKPSACPEPGGGAEPDHGPAHSENTPPALATEVPASQPAPLLSAAAAGDEGRVLLDTWYVIKPGNTKEKVAFFVAHQCGGGSRASSMKVKGHWGSDSSKAKRRRRCLDPTKAPPDPGGREGPPAAEEGPASAGEDVDLLSVAEMVALVEQRAALALQSYPRPTTPAPVVFVSAEQGGPAKGVGSERRSGGGDCSRVAEAVAHFEAQRDSPPTKGLRKEERPGPGPGEVRIAFRISNGREPRAPDSGLPSGGGGRPGCAYPGSPGPGARAKDKITCDLYQLISPSRDALPSNVEFLLARADEASEGDSPAPARPEDTPPAPPPPPARDCGASGFHVDVVVTGVVDECIFFGKDGTKNVKEETVCLTVSPEEPPPPGQLFFLQNRGPDGPPEPPPADSPATAPGPDDAEGTADTSLCRLYRHVSHDFLEIRFKIQRLLEPRQYMLLLPEHVLVKIFSFLPTRALAALKCTCHHFKGIIEAFGVRATDSRWSRDPLYRDDPCKQCRKRYEKGDVSLCRWHPKPYHHDLPYGRSYWMCCRRADRETPGCRLGLHDNNWVLPCNGPGGGRAGREEGR

SEQ ID NO: 46060 - protein, 202 aa, Homo sapiens
MTCLTDVPTGCAAVEPTARLPAAAWASTITTGCCPAMGQAGAGPAGRRGGEAGGGEGRAHHAHPSPLPREPRVRTGPPAHSPTPGSIDPSPELSWGSAGVTQESPLLDPVDFLLFRTRAVDPLRRVFFFFYQHLTFFSIQPQPPPCHAFHPKDPPAGSRRQLILVPLKGPPILAPILSLTPILSRWSCYFPRSRIAQGWHLS

SEQ ID NO: 46061 - protein, 452 aa, Homo sapiens
MASRINTNFTLIPNQKLRRSNRQTSCYSKTLGSGFQPISTFGNFKALPLEIFQIILKYLSVKDISMLSMVSKTVSQHIINYISTSSGSKRLLLQDFHNLELPDRRQDSAILEHYRSLGLLFKRCTLLLPTKERLKYIHKILTEVSCFKFNGCAAPMQCLGLTCYGMFLQTLTAGWDELECHRVYNFLCELTNLCRKIQMAVCSKPGSAQKLELRIRLFCRNVLLDHWTHRSDSAFWLTRILKPWPMVNQARLLYIIFGPISPQDGQVVWQEMIEEPTDEFSLKGLADAIKLLYDASTKEWTADDVISLVDELSVVPREWLLENNARLLMLSGNNICFSFMASKAVNGRTIELARLVVFLALVCEKELYCMDWTVKMMQKVCKVFSTPVERKNFLQNVANAFACVIMEMLQSIMSGDRDEDDRSFLNLFHLVHAQANFHKEVLYLTMNTPLST

SEQ ID NO: 46062 - protein, 447 aa, Homo sapiens
MSRRPCSCALRPPRCSCSASPSAVTAAGRPRPSDSCKEESSTLSVKMKCDFNCNHVHSGLKLVKPDDIGRLVSYTPAYLEGSCKDCIKDYERLSCIGSPIVSPRIVQLETESKRLHNKENQHVQQTLNSTNEIEALETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 46063 - protein, 401 aa, Homo sapiens
MKCDFNCNHVHSGLKLVKPDDIGRLVSYTPAYLEGSCKDCIKDYERLSCIGSPIVSPRIVQLETESKRLHNKENQHVQQTLNSTNEIEALETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 46064 - protein, 293 aa, Homo sapiens
MDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 46065 - protein, 249 aa, Homo sapiens
  MOD_RES (1)..(1): Any amino acid
XNELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 46066 - protein, 522 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 46067 - protein, 443 aa, Homo sapiens
MARPPGGSGPLLDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 46068 - protein, 408 aa, Homo sapiens
MQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 46069 - protein, 232 aa, Homo sapiens
MQLTFAWLHVFGRTLRMMNFSGKGCANPWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 46070 - protein, 319 aa, Homo sapiens
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 46071 - protein, 184 aa, Homo sapiens
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEGVNYFMSKGILDDSPKEIAKFIFCTRTLNWKK

SEQ ID NO: 46072 - protein, 447 aa, Homo sapiens
MPDIIWVFPPQAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 46073 - protein, 437 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 46074 - protein, 403 aa, Homo sapiens
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 46075 - protein, 48 aa, Homo sapiens
MFRAQWMFELAPGVSSSNLENRPCRAARGSLQKTSADTKGKQEQAKEE

SEQ ID NO: 46076 - protein, 118 aa, Homo sapiens
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSY

SEQ ID NO: 46077 - protein, 145 aa, Homo sapiens
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHIS

SEQ ID NO: 46078 - protein, 1043 aa, Homo sapiens
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 46079 - protein, 404 aa, Homo sapiens
MNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQAGARHGAHCGEHRTAPA

SEQ ID NO: 46080 - protein, 1094 aa, Homo sapiens
MSYEVTSGCHWTCQVPESCDNGLHCAGPLGHLHRRCQRTSAHLLVFTEHAEMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 46081 - protein, 547 aa, Homo sapiens
MAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEMESHHVGQAGLELPTSEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 46082 - protein, 404 aa, Homo sapiens; identical to SEQ ID NO: 46079

SEQ ID NO: 46083 - protein, 191 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 46084 - protein, 178 aa, Homo sapiens
MDPKQTTLLCLGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 46085 - protein, 287 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 46086 - protein, 275 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 46087 - protein, 209 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRLHPPRLHDAELDPHGRGRTGPRGSLGHTG

SEQ ID NO: 46088 - protein, 253 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 46089 - protein, 265 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 46090 - protein, 179 aa, Homo sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 46091 - protein, 239 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 46092 - protein, 257 aa, Homo sapiens
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 46093 - protein, 86 aa, Homo sapiens
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 46094 - protein, 112 aa, Homo sapiens
MIPAVVLLLLLLVEQAAALGEPQLCYILDAILFLYGIVLTLLYCRLKIQVRKAAITSYEKSDGVYTMESPSITRLECSGMIWAHCNLCLLGSRDSRASPSRVAKTTGTTMPS

SEQ ID NO: 46095 - protein, 263 aa, Homo sapiens
  MOD_RES (1)..(1): Any amino acid
XCSFGVQLMGKWVPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQG

SEQ ID NO: 46096 - protein, 188 aa, Homo sapiens
MWFLTTLLLWGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 46097 - protein, 280 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 46098 - protein, 317 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 46099 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 46100 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 46101 - protein, 310 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 46102 - protein, 303 aa, Homo sapiens
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 46103 - protein, 303 aa, Homo sapiens; identical to SEQ ID NO: 46102

SEQ ID NO: 46104 - protein, 310 aa, Homo sapiens; identical to SEQ ID NO: 46101

SEQ ID NO: 46105 - protein, 291 aa, Homo sapiens; identical to SEQ ID NO: 46100

SEQ ID NO: 46106 - protein, 234 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQGPRLRTAAKQSSLVGAEVP

SEQ ID NO: 46107 - protein, 256 aa, Homo sapiens
MGILSFLPVLATESDWADCKSPQPWGHMLLWTAVLFLGESGPPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISVSTW

SEQ ID NO: 46108 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 46109 - protein, 290 aa, Homo sapiens
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 46110 - protein, 271 aa, Homo sapiens
  MOD_RES (1)..(1): Any amino acid
XPLGLRISLVTCPLQCGIMWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 46111 - protein, 254 aa, Homo sapiens; identical to SEQ ID NO: 46108

SEQ ID NO: 46112 - protein, 105 aa, Homo sapiens
MWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHI

SEQ ID NO: 46113 - protein, 289 aa, Homo sapiens
MGGGAGERLFTSSCLVGLVPLGLRISLVTCPLQCGIMWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 46114 - protein, 254 aa, Homo sapiens; identical to SEQ ID NO: 46108

SEQ ID NO: 46115 - protein, 233 aa, Homo sapiens
MWQLLLPTALLLLVSAGMRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 46116 - protein, 233 aa, Homo sapiens; identical to SEQ ID NO: 46115

SEQ ID NO: 46117 - protein, 365 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 46118 - protein, 152 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTACGSTWRGAAETWSGRSPPPCA

SEQ ID NO: 46119 - protein, 365 aa, Homo sapiens; identical to SEQ ID NO: 46117

SEQ ID NO: 46120 - protein, 235 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKGCWTKIDTSWGCAQIFIPSATKEKLRLNQSPPPCA

SEQ ID NO: 46121 - protein, 577 aa, Homo sapiens
MDGEATVKPGEQKEVVRRGREVDYSRLIAGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSRTLAPVSTMLALFMLMALVLLQRKLWRRRTSQEAERVTLIQMTHFLEVNPQADQLPHVERKMLQDDSLPAGASLTAPERNPGP

SEQ ID NO: 46122 - protein, 535 aa, Homo sapiens
MDGEATVKPGEQKVPLWTHGWPPDDPSPSFAAGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWITSMEAASGEGSAAGDLDAATGDRGPQATLSQTPAVGPWGPPGKESSVKRATCPGLSTLKEIKVSAVLTQNPHSLLCVSAAQEAERVTLIQMTHFLEVNPQADQLPHVERKMLQDDSLPAGASLTAPERNPGP

SEQ ID NO: 46123 - protein, 265 aa, Homo sapiens
MDGEATVKPGEQKEVVRRGREVDYSRLIAGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAVLFQKMKAALGPWLLSLPCWPCLCLWLWFYCKGSSGEGGPLRRQKGSP

SEQ ID NO: 46124 - protein, 265 aa, Homo sapiens; identical to SEQ ID NO: 46123

SEQ ID NO: 46125 - protein, 366 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTGRRSARDPLRSLPSPLPQEFTYLNSPTPGQLQPIYENEPREQSVAVHGRQQHSSEQKAQKPWGHIWRTRFP

SEQ ID NO: 46126 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 46127 - protein, 428 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAETLGTHMEDKVSLDIYSRLRKANITDVDYEDAM

SEQ ID NO: 46128 - protein, 889 aa, Homo sapiens
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 46129 - protein, 889 aa, Homo sapiens; identical to SEQ ID NO: 46128

SEQ ID NO: 46130 - protein, 889 aa, Homo sapiens; identical to SEQ ID NO: 46128

SEQ ID NO: 46131 - protein, 891 aa, Homo sapiens
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATAAPPQGCTW

SEQ ID NO: 46132 - protein, 839 aa, Homo sapiens
MAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEAMKRLRGAKAFRLPGLSRREREPEPPAAVDFLEPDSGTCPEVDEEGFTVRPDVTQNSTAEPSRFSSSDSDFDDEEPRKFYVHIKPAPARAPACSPEAAAAQLRATAGSLILPPGPGGTMKRHSSRDAAGKPQRPRSAPRTSSCAERLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATGMYLVSC

SEQ ID NO: 46133 - protein, 889 aa, Homo sapiens; identical to SEQ ID NO: 46128

SEQ ID NO: 46134 - protein, 889 aa, Homo sapiens; identical to SEQ ID NO: 46128

SEQ ID NO: 46135 - protein, 378 aa, Homo sapiens
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVWSFTVVAQVGMQWRDLGLLHSPPPRFKRFSSYLSLPSSWNYGAHHHIWLIFCIFSRDRVSPYWPGWSRTPDLR

SEQ ID NO: 46136 - protein, 810 aa, Homo sapiens
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISVSTNTRLNRNFNDEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 46137 - protein, 810 aa, Homo sapiens
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 46138 - protein, 777 aa, Homo sapiens
MVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 46139 - protein, 555 aa, Homo sapiens
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIAFKEKPRYPPSQAQAALQDSPPEEYSYKKSIRNLFKNIPFVLLLITYGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 46140 - protein, 822 aa, Homo sapiens
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSALGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 46141 - protein, 647 aa, Homo sapiens
MKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSALGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 46142 - protein, 326 aa, Homo sapiens
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMKERRGYPNLNLFVIQLLE

SEQ ID NO: 46143 - protein, 1284 aa, Homo sapiens
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 46144 - protein, 1309 aa, Homo sapiens
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 46145 - protein, 1277 aa, Homo sapiens
MSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 46146 - protein, 261 aa, Homo sapiens
MGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 46147 - protein, 1311 aa, Homo sapiens [sequence omitted]

SEQ ID NO: 46148 - protein, 1322 aa, Homo sapiens
MDVFSFVKIAKLSSHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTV

SEQ ID NO: 46149 - protein, 1313 aa, Homo sapiens
KSHSPHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTG

SEQ ID NO: 46150 - protein, 597 aa, Homo sapiens
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 46151 - protein, 213 aa, Homo sapiens
MQAEETKGIGITSMAKCLVKIQTRRSLQLHMVNHCNSNVFVRLLRLGSKVTARNTGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 46152 - protein, 267 aa, Homo sapiens
MCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRCVQKKICSCFGVTW

SEQ ID NO: 46153 - protein, 362 aa, Homo sapiens
MVFRRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 46154 - protein, 556 aa, Homo sapiens
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 46155 - protein, 140 aa, Homo sapiens
GTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRCVQKKICSCFGVTW

SEQ ID NO: 46156 - protein, 714 aa, Homo sapiens
MLHLKVQFLDDSQKIFVVDQKSSGKALFNLSCSHLNLAEKEYFGLEFCSHSGNNVWLELLKPITKQVKNPKEIVFKFMVKFFPVDPGHLREELTRYLFTLQIKKDLALGRLPCSDNCTALMVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 46157 - protein, 594 aa, Homo sapiens
MVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 46158 - protein, 680 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 46159 - protein, 687 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 46160 - protein, 680 aa, Homo sapiens; identical to SEQ ID NO: 46158

SEQ ID NO: 46161 - protein, 633 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVNS

SEQ ID NO: 46162 - protein, 687 aa, Homo sapiens; identical to SEQ ID NO: 46159

SEQ ID NO: 46163 - protein, 153 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKK

SEQ ID NO: 46164 - protein, 667 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRIPRRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 46165 - protein, 663 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 46166 - protein, 286 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDC

SEQ ID NO: 46167 - protein, 184 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 46168 - protein, 497 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLEALLLCQRTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46169 - protein, 522 aa, Homo sapiens
MASRCWRWWGWSAWPRTRLPPAGSTPTFGGSDEVRDPANAKALRNKRRRMQVRVKLGKFQLLLDIQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46170 - protein, 451 aa, Homo sapiens
MASRCWRWWGWSAWPRTRLPPAGSTPSFCHHFSTQEKTPQICVVGSGPAGFYTAQHLLKQHPQAHVDIYEKQPVPFGLVRFGVAPDHPEVKSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46171 - protein, 534 aa, Homo sapiens
MASRCWRWWGWSAWPRTRLPPAGSTPSFCHHFSTQEKTPQICVVGSGPAGFYTAQHLLKRVEALCSQPRVLNSPALSGEGEDLGASQPLSLDPTSCHPVPQQHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46172 - protein, 381 aa, Homo sapiens [sequence omitted]

SEQ ID NO: 46173 - protein, 439 aa, Homo sapiens
MEDKDREHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46174 - protein, 497 aa, Homo sapiens; identical to SEQ ID NO: 46168

SEQ ID NO: 46175 - protein, 483 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 46176 - protein, 626 aa, Homo sapiens
MAVSGFTLGTCILLLHISYVANYPNGKVTQSCHGMIPEHGHSPQSVPVHDIYVSQMTFRPGDQIEVTLSGHPFKGFLLEARNAEDLNGPPIGSFTLIDSEVSQLLTCEDIQGSAVSHRSASKKTEIKVYWNAPSSAPNHTQFLVTVVEKYKIYWVKIPGPIISQPNAFPFTTPKATVVPLPTLPPVSHLTKPFSASDCGNKKFCIRSPLNCDPEKEASCVFLSFTRDDQSVMVEMSGPSKGYLSFALSHDQWMGDDDAYLCIHEDQTVYIQPSHLTGRSHPVMDSRDTLEDMAWRLADGVMQCSFRRNITLPGVKNRFDLNTSYYIFLADGAANDGRIYKHSQQPLITYEKYDVTDSPKNIGGSHSVLLLKVHGALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHVGTEVVLELKYWMMTEFRSFSHLLQWKQRVMLLKRQCWQFMSVGMLLFSSYFYLQSTIYEQAKTLAFAGQVIIIIKPKKLEACPDCLEHICEFSLGRLGSCL

SEQ ID NO: 46177 - protein, 592 aa, Homo sapiens
MAVSGFTLGTCILLLHISYVANYPNGKVTQSCHGMIPEHGHSPQSVPVHDIYVSQMTFRPGDQIEVTLSGHPFKGFLLEARNAEDLNGPPIGSFTLIDSEVSQLLTCEDIQGSAVSHRSASKKTEIKVYWNAPSSAPNHTQFLVTVVEKYKIYWVKIPGPIISQPNAFPFTTPKATVVPLPTLPPVSHLTKPFSASDCGNKKFCIRSPLNCDPEKEASCVFLSFTRDDQSVMVEMSGPSKGYLSFALSHDQWMGDDDAYLCIHEDQTVYIQPSHLTGRSHPVMDSRDTLEDMAWRLADGVMQCSFRRNITLPGVKNRFDLNTSYYIFLADGAANDGRIYKHSQQPLITYEKYDVTDSPKNIGGSHSVLLLKVHGALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHVGTEVVLEVHAYRLSRKVEILDDDRIQILQSFTAVETEGHAFKKAVLAIYVCGNVTFLIIFLSAINHL

SEQ ID NO: 46178 - protein, 242 aa, Homo sapiens [sequence omitted]

SEQ ID NO: 46179 - protein, 183 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 46180 - protein, 232 aa, Homo sapiens
SGFPASTVLGRNPALVPHPGRPPIASPPSPLHRTLGLPQGPRRLSLVAAMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 46181 - protein, 153 aa, Homo sapiens
MTTASTSQSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 46182 - protein, 183 aa, Homo sapiens
MATAQPSQVRQKYDTNCDAAINSHITLELYTSYLYLSMAFYFNRDDVALENFFRYFLRLSDDKMEHAQKLMRLQNLRGGHICLHDIRKPECQGWESGLVAMESAFHLEKNVNQSLLDLYQLAVEKGDPQLCHFLESHYLHEQVKTIKELGGYVSNLRKICSPEAGLAEYLFDKLTLGGRVKET

SEQ ID NO: 46183 - protein, 175 aa, Homo sapiens
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 46184 - protein, 190 aa, Homo sapiens
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLSKGSLSSTTKSLLSPATSEGPLAK

SEQ ID NO: 46185 - protein, 423 aa, Homo sapiens
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 46186 - protein, 429 aa, Homo sapiens
MRSLGANMAAALRAAGVLLRDPLASSSWRVCQPWRWKSGAAAAAVTTETAQHAQGAKPQVQPQKRYESNIRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 46187 - protein, 382 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 46188 - protein, 382 aa, Homo sapiens; identical to SEQ ID NO: 46187

SEQ ID NO: 46189 - protein, 234 aa, Homo sapiens
MTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 46190 - protein, 238 aa, Homo sapiens
MRQSGASQPLLINMYLPDPVGDGLFKDGKNPSWGPLSPAVQKGSGQIQLWQFLLELLADRANAGCIAWEGGHGEFKLTDPDEVARRWGERKSKPNMNYDKLSRALRYYYDKNIMSKVHGKRYAYRFDFQGLAQACQPPPAHAHAAAAAAAAAAAAQDGALYKLPAGLAPLPFPGLSKLNLMAASAGVAPAGFSYWPGPGPAATAAAATAALYPSPSLQPPPGPFGAVAAASHLGGHYH

SEQ ID NO: 46191 - protein, 471 aa, Homo sapiens
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLVRPRVVNHSSFHAMGALCYLNRGDGPCHPAAGVNIHPVASYFLSSPLHPQPKTYLAERNKLVVPAVEKYPSGVAFKDLSQAQLQHYMKESAQLLSEKIAFKTSDFSRGSPNAKPKVFTCEVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 46192 - protein, 35 aa, Homo sapiens
MDSSCHNATTKMLATAPARGNMMSTSKPLAFSIER

SEQ ID NO: 46193 - protein, 425 aa, Homo sapiens
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLPKTYLAERNKLVVPAVEKYPSGVAFKDLSQAQLQHYMKESAQLLSEKIAFKTSDFSRGSPNAKPKVFTCEVCGKVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 46194 - protein, 475 aa, Homo sapiens
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLVRPRVVNHSSFHAMGALCYLNRGDGPCHPAAGVNIHPVASYFLSSPLHPQPKTYLAERNKLVVPAVEKYPSGVAFKDLSQAQLQHYMKESAQLLSEKIAFKTSDFSRGSPNAKPKVFTCEVCGKVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 46195 - protein, 459 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 46196 - protein, 459 aa, Homo sapiens; identical to SEQ ID NO: 46195

SEQ ID NO: 46197 - protein, 459 aa, Homo sapiens; identical to SEQ ID NO: 46195

SEQ ID NO: 46198 - protein, 379 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 46199 - protein, 399 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 46200 - protein, 364 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKTITQLECLLSIGALHFKNTADIFKVIFILLNKILPI

SEQ ID NO: 46201 - protein, 321 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDHAVVVGVYRPPPKVKN

SEQ ID NO: 46202 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSCRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 46203 - protein, 985 aa, Homo sapiens
MGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDVILSLLLLSPAFPSCFFSPRTIGKGTASQRCYKTCVRSAPATGTPSPNRNAAVTEGEAGVPTVRSALSRGLWLSRNSVPMAEDS

SEQ ID NO: 46204 - protein, 1149 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCTYINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCT

SEQ ID NO: 46205 - protein, 2912 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 46206 - protein, 2912 aa, Homo sapiens; identical to SEQ ID NO: 46205

SEQ ID NO: 46207 - protein, 198 aa, Homo sapiens
MGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGPLDWCTLSLALLVPVAPSPTPPHSFVNVLHPPVPGGPTLQ

SEQ ID NO: 46208 - protein, 303 aa, Homo sapiens
MGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 46209 - protein, 461 aa, Homo sapiens
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 46210 - protein, 310 aa, Homo sapiens
  MOD_RES (1)..(1): Any amino acid
XTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGPLDWCTLSLALLVPVAPSPTPPHSFVNVLHPPVPGGPTLQ

SEQ ID NO: 46211 - protein, 461 aa, Homo sapiens; identical to SEQ ID NO: 46209

SEQ ID NO: 46212 - protein, 289 aa, Homo sapiens
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRRE

SEQ ID NO: 46213 - protein, 179 aa, Homo sapiens
MVNDRWKTMGGAAQLEDRPRDKPQARKLRLRERPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQG

SEQ ID NO: 46214 - protein, 312 aa, Homo sapiens
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 46215 - protein, 312 aa, Homo sapiens; identical to SEQ ID NO: 46214

SEQ ID NO: 46216 - protein, 312 aa, Homo sapiens; identical to SEQ ID NO: 46214

SEQ ID NO: 46217 - protein, 312 aa, Homo sapiens; identical to SEQ ID NO: 46214

SEQ ID NO: 46218 - protein, 312 aa, Homo sapiens; identical to SEQ ID NO: 46214

SEQ ID NO: 46219 - protein, 312 aa, Homo sapiens; identical to SEQ ID NO: 46214

SEQ ID NO: 46220 - protein, 312 aa, Homo sapiens; identical to SEQ ID NO: 46214

SEQ ID NO: 46221 - protein, 282 aa, Homo sapiens
MRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 46222 - protein, 312 aa, Homo sapiens; identical to SEQ ID NO: 46214

SEQ ID NO: 46223 - protein, 439 aa, Homo sapiens
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 46224 - protein, 364 aa, Homo sapiens
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 46225 - protein, 357 aa, Homo sapiens
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQALWDRYMGTLRGCLLRLYHD

SEQ ID NO: 46226 - protein, 662 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKVWNLKAPLVHTPRPGSQECPGDRGQCDEDSRLWPRTGHSPHRLL

SEQ ID NO: 46227 - protein, 367 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSVPIDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKDCWS

SEQ ID NO: 46228 - protein, 731 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46229 - protein, 812 aa, Homo sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46230 - protein, 822 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSVPIDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVLEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46231 - protein, 733 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46232 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46233 - protein, 733 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46234 - protein, 820 aa, Homo sapiens; identical to SEQ ID NO: 46232

SEQ ID NO: 46235 - protein, 820 aa, Homo sapiens; identical to SEQ ID NO: 46232

SEQ ID NO: 46236 - protein, 107 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPS

SEQ ID NO: 46237 - protein, 853 aa, Homo sapiens
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46238 - protein, 55 aa, Homo sapiens
MWSWKCLLFWAVLVTATLCTARPSPTLPEQDALPSSEDDDDDDDSSSEEKETDNT

SEQ ID NO: 46239 - protein, 1 aa, Homo sapiens
M

SEQ ID NO: 46240 - protein, 822 aa, Homo sapiens [sequence omitted]

SEQ ID NO: 46241 - protein, 298 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGS

SEQ ID NO: 46242 - protein, 145 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEY

SEQ ID NO: 46243 - protein, 142 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCI

SEQ ID NO: 46244 - protein, 85 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKF

SEQ ID NO: 46245 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 46246 - protein, 669 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRI

SEQ ID NO: 46247 - protein, 819 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46248 - protein, 785 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEPYSPCYPDPR

SEQ ID NO: 46249 - protein, 704 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46250 - protein, 707 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 46251 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46252 - protein, 254 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 46253 - protein, 680 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 46254 - protein, 769 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 46255 - protein, 768 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNE

SEQ ID NO: 46256 - protein, 707 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46257 - protein, 705 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46258 - protein, 709 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46259 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVTKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46260 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 46261 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 46262 - protein, 504 aa, Homo sapiens; identical to SEQ ID NO: 46261

SEQ ID NO: 46263 - protein, 504 aa, Homo sapiens; identical to SEQ ID NO: 46261

SEQ ID NO: 46264 - protein, 152 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQP

SEQ ID NO: 46265 - protein, 504 aa, Homo sapiens; identical to SEQ ID NO: 46261

SEQ ID NO: 46266 - protein, 80 aa, Homo sapiens
MTPSPLLLLLLPPLLLGAFPPAAAARGPPKMADKVVPRQVARLGRTVRLQCPVEGDPPPLTMWTKDGRTIHSGWSRFRVL

SEQ ID NO: 46267 - protein, 441 aa, Homo sapiens
MADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHPTVVVAPDLCNFM

SEQ ID NO: 46268 - protein, 376 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 46269 - protein, 363 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 46270 - protein, 197 aa, Homo sapiens
MKMTLIGGSTTSAASSPPTTIPMTLTRMRPTSLTPMGWMKGQPTPTALHPLQIPATAPRSATAHPTSTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGRTSRPCTSNTMRSRKWAVP

SEQ ID NO: 46271 - protein, 674 aa, Homo sapiens
MVVAHPTATATTTPTATVTATVVMTTATMDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSRKKDDYMESGTKKDNSILEIRGPGLQMLPINPYRAKEEYVVHTIFPSNGSSLCKATHTIGYGTTRGYRDGGIPDIDYSYT

SEQ ID NO: 46272 - protein, 660 aa, Homo sapiens
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 46273 - protein, 313 aa, Homo sapiens
MAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 46274 - protein, 660 aa, Homo sapiens; identical to SEQ ID NO: 46272

SEQ ID NO: 46275 - protein, 649 aa, Homo sapiens
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 46276 - protein, 649 aa, Homo sapiens; identical to SEQ ID NO: 46275

SEQ ID NO: 46277 - protein, 627 aa, Homo sapiens [sequence omitted]

SEQ ID NO: 46278 - protein, 133 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSSIWLGGEPISSEHLHRAVSVNDEDLLVRILQGG

SEQ ID NO: 46279 - protein, 282 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSSIWLGGEPISSEHLHRAVSVNDEDLLVRILQGGRVKVDVPNKFGFTALMVAAQKGYTSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMSVVSLLEERKKKQRPKKSCVC

SEQ ID NO: 46280 - protein, 371 aa, Homo sapiens
LQKQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTRPSLSKSLVKIRMVTSVLHGPPTENTGEPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 46281 - protein, 345 aa, Homo sapiens
MEPQKIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 46282 - protein, 339 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 46283 - protein, 124 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRIL

SEQ ID NO: 46284 - protein, 133 aa, Homo sapiens; identical to SEQ ID NO: 46278

SEQ ID NO: 46285 - protein, 146 aa, Homo sapiens
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSEYSDRPHSPLSRSMEMTSNLEKIFCLSFGLTRSRNDTIFKHCNNIC

SEQ ID NO: 46286 - protein, 199 aa, Homo sapiens
  MOD_RES (1)..(1): Any amino acid
XEPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMSVVSLLEERKKKQRPKKSCVC

SEQ ID NO: 46287 - protein, 496 aa, Homo sapiens
MEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQVSFTAKHANKVKVLDAPVPDCLGVHCDFHQGLLSFYNARTKQVLHTFKTRFTQPLLPAFTVWCGSFQVTTGLQVPSAVRCLQKRGSATSSSNTSLT

SEQ ID NO: 46288 - protein, 498 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 46289 - protein, 145 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKVHKNCINTLNKGSCIFKKAFLFFFSFGFLY

SEQ ID NO: 46290 - protein, 530 aa, Homo sapiens
MDSQKYCFKENENVTVDKACFLISNITIGPESINLQQEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 46291 - protein, 383 aa, Homo sapiens
MASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSVHVTSLKKHTSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 46292 - protein, 1894 aa, Homo sapiens
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 46293 - protein, 1831 aa, Homo sapiens
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKASKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 46294 - protein, 1204 aa, Homo sapiens
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 46295 - protein, 71 aa, Homo sapiens
MYVTMMMTDQIPLELPPLLNGEVAMMPHLVNGDAAQQVILVQVNPGETFTIRAEDGTLQCIQEVNVKRHCL

SEQ ID NO: 46296 - protein, 1204 aa, Homo sapiens; identical to SEQ ID NO: 46294

SEQ ID NO: 46297 - protein, 1204 aa, Homo sapiens; identical to SEQ ID NO: 46294

SEQ ID NO: 46298 - protein, 208 aa, Homo sapiens
MFTKEKIWSEVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGG

SEQ ID NO: 46299 - protein, 234 aa, Homo sapiens
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 46300 - protein, 825 aa, Homo sapiens
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASEHPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESPSEEPPAEILPPPAEKSPSVELLGEIRSPSAQKAPIEVQPLPAEGALEEAPAKVEPPTVEETLADVQPLLPEEAPREEARELQLSTAMETPAEEAPTEFQSPLPKETTAEEASAEIQLLAATEPPADETPAEARSPLSEETSAEEAHAEVQSPLAEETTAEEASAEIQLLAAIEAPADETPAEAQSPLSEETSAEEAPAEVQSPSAKGVSIEEAPLELQPPSGEETTAEEASAAIQLLAATEASAEEAPAEVQPPPAEEAPAEVQPPPAEEAPAEVQPPPAEEAPAEVQPPPAEEAPAEVQPPPAEEAPAEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 46301 - protein, 718 aa, Homo sapiens
MVGKSQQTDVIEKKKHMAIPKSSSPKATHRIGNTSGSKGSYSAKAYESIRVSSELQQTWTKRKHGQEMTSKSLQTDTIVEEKKEVKLVEETVVPEEKSADVREAAIELPESVQDVEIPPNIPSVQLKMDRSQQTSRTGYWTMMNIPPVEKVDKEQQTYFSESEIVVISRPDSSSTKSKEDALKHKSSGKIFASEHPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESPSEEPPAEILPPPAEKSPSVELLGEIRSPSAQKAPIEVQPLPAEGALEEAPAKVEPPTVEETLADVQPLLPEEAPREEARELQLSTAMETPAEEAPTEFQSPLPKETTAEEASAEIQLLAATETSAEEAPAEVQSPSAEEAPAEVQPPPAEEAPAEVQPPPAEEAPAEVQPPPAEEAPAEVQPPPAEEAPAEVQPPPAEEAPAEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 46302 - protein, 683 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 46303 - protein, 703 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 46304 - protein, 566 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAAT

SEQ ID NO: 46305 - protein, 703 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATQKSKKGRQNTPAGSSKEDCRVLPWKQGLEDTHLDAYLPCCRRFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 46306 - protein, 721 aa, Homo sapiens
MERAAPSRRVPLPLLLLGGLALLAAGVDADVLLEACCADGHRMATHQKDCSLPYATESKECRAVGLASLCQDLNGAWAVWKVGRASQAEGTASARAQRRGMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 46307 - protein, 189 aa, Homo sapiens
MNSYTRGSRRPSAKAASPAASVTSRVSPSGPGVPVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 46308 - protein, 26 aa, Homo sapiens
MATHQKDCSLPYATESKECRMVQEQC

SEQ ID NO: 46309 - protein, 601 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATQKSKKGRQNTPAGSSKEDCRVLPWKQGLEDTHLDA

SEQ ID NO: 46310 - protein, 65 aa, Homo sapiens
MATHQKDCSLPYATESKECRMVQEQCCHSQLEELHCATGISLANEQDRCATPHGDNASLEATFVK

SEQ ID NO: 46311 - protein, 181 aa, Homo sapiens
CRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRDTGDEVVCSCFVGYQLLSDGVSCEDVNECITGSHSCRLGESCINTVGSFRCQRDSSCGTGYELTEDNSCK

SEQ ID NO: 46312 - protein, 139 aa, Homo sapiens
MATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 46313 - protein, 172 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRD

SEQ ID NO: 46314 - protein, 1184 aa, Homo sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 46315 - protein, 1231 aa, Homo sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDQDECLMGAHDCSRRQFCVNTLGSFYCVNHTVLCADGYILNAHRKCVDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 46316 - protein, 159 aa, Homo sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRA

SEQ ID NO: 46317 - protein, 1231 aa, Homo sapiens; identical to SEQ ID NO: 46315

SEQ ID NO: 46318 - protein, 1210 aa, Homo sapiens
METSLSLESGHHGSYRRGDRPGLAWTMVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 46319 - protein, 448 aa, Homo sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 46320 - protein, 91 aa, Homo sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGP

SEQ ID NO: 46321 - protein, 439 aa, Homo sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 46322 - protein, 393 aa, Homo sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 46323 - protein, 313 aa, Homo sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 46324 - protein, 275 aa, Homo sapiens
MELDRAVGVLGAATLLLSFLGMAWALQAADTCPGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 46325 - protein, 187 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQ

SEQ ID NO: 46326 - protein, 326 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 46327 - protein, 360 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQTHSHDAHSCPFAPSSVKPPHAHNLTRGRIMFLNMFTLGQKSFTSFNVCFLNTSGFDHFPVSVARQVFPWNLVSREESGPLFSRWHYRCSGRLSDFCEDFPPPVIDTGRSSPPPPSLPHPPMPHSQHFTLLEKGHFGVQKTLTKKGESLVGTFLLPTTAEFMLWAGWLLGRDKHLALTK

SEQ ID NO: 46328 - protein, 299 aa, Homo sapiens
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 46329 - protein, 288 aa, Homo sapiens
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 46330 - protein, 99 aa, Homo sapiens
MDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGE

SEQ ID NO: 46331 - protein, 907 aa, Homo sapiens
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITLDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 46332 - protein, 139 aa, Homo sapiens
MGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSG

SEQ ID NO: 46333 - protein, 136 aa, Homo sapiens
  MOD_RES (1)..(1): Any amino acid
XLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEGFLARSPANLECSN

SEQ ID NO: 46334 - protein, 99 aa, Homo sapiens
MTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTE

SEQ ID NO: 46335 - protein, 601 aa, Homo sapiens
MTGYLRIFQNVDLSSNFYFSYSYDLSHSLQYNLTVLRMPLEMLKSEMTQNRQESFDIFEDEGLITQGGSVDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRTPISAFSQDNIYEVQPPRVDRKSTEIFQAHIQASQGIMQPLGKEDSSMYREYIRNRYL

SEQ ID NO: 46336 - protein, 237 aa, Homo sapiens
MRYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQS

SEQ ID NO: 46337 - protein, 322 aa, Homo sapiens
LYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSG

SEQ ID NO: 46338 - protein, 322 aa, Homo sapiens
LYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSG

SEQ ID NO: 46339 - protein, 4061 aa, Homo sapiens
MSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQVSTHKQSESSHGWTGPSTGVRQGSHHEQARDNSRHSASQDGQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGHGHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASSWADSSRHSLVGQGQSSGPRTSRPRGSSVSQDSDSEGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQYGQDTIRGHPGSSRGGRQGYHHEHSVDSSGHSGSHHSHTTSQGRSDASRGQSGSRSASRTTRNEEQSGDSSRHSVSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSGSFLYQVSTHEQSESAHGRTRTSTGRRQGSHHEQARDSSRHSASQEGQDTIRGHPGSSRRGRQGSHYEQSVDRSGHSGSHHSHTTSQGRSDASRGQSGSRSASRQTRNDEQSGDGSRHSWSHHHEASTQADSSRHSQSGQGQSAGPRTSRNQGSSVSQDSDSQGHSEDSERWSGSASRNHRGSAQEQSRDGSRHPTSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 46340 - protein, 322 aa, Homo sapiens
LYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSG

SEQ ID NO: 46341 - protein, 1133 aa, Homo sapiens
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 46342 - protein, 1135 aa, Homo sapiens
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 46343 - protein, 893 aa, Homo sapiens
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 46344 - protein, 255 aa, Homo sapiens
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERWSLALLPRLECNGMILAHCNLCLLGSSDSPASAFQVAGITGTRHHAQLVFVFL

SEQ ID NO: 46345 - protein, 879 aa, Homo sapiens
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 46346 - protein, 895 aa, Homo sapiens
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 46347 - protein, 711 aa, Homo sapiens
MALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 46348 - protein, 837 aa, Homo sapiens
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASP

SEQ ID NO: 46349 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 46350 - protein, 2315 aa, Homo sapiens
MPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 46351 - protein, 780 aa, Homo sapiens
MPSGKVAQPTITDNKDGTVTVRYAPSEAGLHEMDIRYDNMHIPGSPLQFYVDYVNCGHVTAYGPGLTHGVVNKPATFTVNTKDAGEGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP
